United States Patent 8,354,514 (MULTIPLEX DETECTION OF AGRICULTURAL PATHOGENS) - sequence listing, part 2

SEQ ID NO: 18204 - DNA, 60 bp, Artificial Sequence
  Description of Artificial Sequence: Synthetic probe
gtttaatgcgcgattgcggctaacccatggagagattgcgtcgcgtaagactgacgaccc

SEQ ID NO: 18205 - DNA, 60 bp, Artificial Sequence
  Description of Artificial Sequence: Synthetic probe
gataaattcacccatgtttaatgcgcgattgcggctaacccatggagagattgcgtcgcg

SEQ ID NO: 18206 - DNA, 60 bp, Artificial Sequence
  Description of Artificial Sequence: Synthetic probe
acagggcggttgggaccaggagcggttcaagctccatagcatattgaccgaacctaacct

SEQ ID NO: 18207 - DNA, 60 bp, Artificial Sequence
  Description of Artificial Sequence: Synthetic probe
gacggctatatgtgtgtgtcgcatgaaatagatggtgagttactctgtagaattgacgac

SEQ ID NO: 18208 - DNA, 60 bp, Artificial Sequence
  Description of Artificial Sequence: Synthetic probe
cggtgggagacaaagtcatacactggcgatatgatctgactaagccaatggatacgactt

SEQ ID NO: 18209 - DNA, 60 bp, Artificial Sequence
  Description of Artificial Sequence: Synthetic probe
actactctttacgtcacacttatcaatggagtctgcgcccggaatatgatcagcgagaga

SEQ ID NO: 18210 - DNA, 60 bp, Artificial Sequence
  Description of Artificial Sequence: Synthetic probe
gacaaacgaaggaagattttacgccctcattgccattgctgccacagatactcagagggg

SEQ ID NO: 18211 - DNA, 60 bp, Artificial Sequence
  Description of Artificial Sequence: Synthetic probe
gaaatcgtgagcgaagtggtgcggttgaatgagattagaactgagtggataaacgcaggg

SEQ ID NO: 18212 - DNA, 60 bp, Artificial Sequence
  Description of Artificial Sequence: Synthetic probe
ggtaccgtatgaaaggttcatctcaagcatggttcaggttgtggtaaagggtaaggttcc

SEQ ID NO: 18213 - DNA, 60 bp, Artificial Sequence
  Description of Artificial Sequence: Synthetic probe
gggctgcctacaatttgaaagccaattatgaattaatcgcaaactcagaaagagaaagtc

SEQ ID NO: 18214 - DNA, 60 bp, Artificial Sequence
  Description of Artificial Sequence: Synthetic probe
acgaatttggatttgttgaggagtttgacagctgttgagatgtttcacgtactacagggg

SEQ ID NO: 18215 - DNA, 58 bp, Artificial Sequence
  Description of Artificial Sequence: Synthetic probe
actcgatagattaccaactcttcaattgtgttgtgaaggctaaaacggcgaatgcgga

SEQ ID NO: 18216 - DNA, 60 bp, Artificial Sequence
  Description of Artificial Sequence: Synthetic probe
gcttcccacaatggaggaattcgtaatcccagtattctcggagcaggacatgccttatgc

SEQ ID NO: 18217 - DNA, 60 bp, Artificial Sequence
  Description of Artificial Sequence: Synthetic probe
tcgcaatcaccgtgcaaggtgcacagctcatcaagcgagtggtcgaacgcttttatccgg

SEQ ID NO: 18218 - DNA, 60 bp, Artificial Sequence
  Description of Artificial Sequence: Synthetic probe
ggtcgcaatcaccgtgcaaggtgcacagctcatcaagcgagtggtcgaacgcttttatcc

SEQ ID NO: 18219 - DNA, 60 bp, Artificial Sequence
  Description of Artificial Sequence: Synthetic probe
tgcacgctttcaagtgatatgagcgtggcgtttaagcttaacggcacatcaacggaaata

SEQ ID NO: 18220 - DNA, 51 bp, Artificial Sequence
  Description of Artificial Sequence: Synthetic probe
tgctgaagagatcaggtatgtgcaacaactttttggaagggttccaacggg

SEQ ID NO: 18221 - DNA, 54 bp, Artificial Sequence
  Description of Artificial Sequence: Synthetic probe
agtgctcttctgaaggagtctagcgctaaggcgttattatctagtggttataga

SEQ ID NO: 18222 - DNA, 60 bp, Artificial Sequence
  Description of Artificial Sequence: Synthetic probe
ccgccatgttggaacgagactcagggagacaagcgcggactgatcagtgcaaccaaactg

SEQ ID NO: 18223 - DNA, 60 bp, Artificial Sequence
  Description of Artificial Sequence: Synthetic probe
ccggaatcccttagcgttatatgttcctataggttggaatgggtacggtgcacatccagc

SEQ ID NO: 18224 - DNA, 60 bp, Artificial Sequence
  Description of Artificial Sequence: Synthetic probe
ccaagggatcagagaggctatggctccctatcgggctttgcgatatgaaggttatacgtt

SEQ ID NO: 18225 - DNA, 60 bp, Artificial Sequence
  Description of Artificial Sequence: Synthetic probe
gacgttggttcatgcgtgccgcccaagcagcaactgcggtagtgtgtggtccggatatga

SEQ ID NO: 18226 - DNA, 60 bp, Artificial Sequence
  Description of Artificial Sequence: Synthetic probe
caggagagagttgaagagctaagtctggttcgcgtggatgatgcaatttcacaaccaccg

SEQ ID NO: 18227 - DNA, 60 bp, Artificial Sequence
  Description of Artificial Sequence: Synthetic probe
taatcaggagagagttgaagagctaagtctggttcgcgtggatgatgcaatttcacaacc

SEQ ID NO: 18228 - DNA, 60 bp, Artificial Sequence
  Description of Artificial Sequence: Synthetic probe
tgggattggaacctagcatttatgaggtaatgaagaagtcggtgatagctacagcttggg

SEQ ID NO: 18229 - DNA, 60 bp, Artificial Sequence
  Description of Artificial Sequence: Synthetic probe
cgacatgtaaatgaacaaattctgccaaaattgaaaagtgacctaggaggcttaaagaag

SEQ ID NO: 18230 - DNA, 60 bp, Artificial Sequence
  Description of Artificial Sequence: Synthetic probe
gcagatcccgacctgtggtgtgattgatgtacgcgcatcagagctaactgggtgttcgcc

SEQ ID NO: 18231 - DNA, 60 bp, Artificial Sequence
  Description of Artificial Sequence: Synthetic probe
cggagaaggctgcattcgcatcgtacgcggaagcgtttcgtgatgatgtaagattgagac

SEQ ID NO: 18232 - DNA, 60 bp, Artificial Sequence
  Description of Artificial Sequence: Synthetic probe
cggagaaggctgcattcgcatcgtacgcggaagcgtttcgtgatgatgtgagattgagac

SEQ ID NO: 18233 - DNA, 60 bp, Artificial Sequence
  Description of Artificial Sequence: Synthetic probe
gcagcggcgaatgattttgaggatttgatgctgactgatcaagtatatatgcacagagat

SEQ ID NO: 18234 - DNA, 60 bp, Artificial Sequence
  Description of Artificial Sequence: Synthetic probe
tcttaggtgataaaatagatgttcccctcttcttacggaatgcttgaacgcagcggggga

SEQ ID NO: 18235 - DNA, 60 bp, Artificial Sequence
  Description of Artificial Sequence: Synthetic probe
acgtttagcagcgcgatacatgcgaggcgtatgataaggtcacgcgcggtacaccccatc

SEQ ID NO: 18236 - DNA, 60 bp, Artificial Sequence
  Description of Artificial Sequence: Synthetic probe
ccacgtacgcaacagcctcaaattcatatctatgcggctccatgggattcagacgatgtc

SEQ ID NO: 18237 - DNA, 60 bp, Artificial Sequence
  Description of Artificial Sequence: Synthetic probe
tagacaaaagattgatgcactcaagagcgcgatagagattgagcgtgacgggatgcagga

SEQ ID NO: 18238 - DNA, 60 bp, Artificial Sequence
  Description of Artificial Sequence: Synthetic probe
gcgaagagctgcctgatcccctcagcccaggtgagcgcggcatgcagatgaagataaaag

SEQ ID NO: 18239 - DNA, 60 bp, Artificial Sequence
  Description of Artificial Sequence: Synthetic probe
ttggtaaggcggcggagcgttttgcggagagtgagataggtgcggcgacgattgatggat

SEQ ID NO: 18240 - DNA, 52 bp, Artificial Sequence
  Description of Artificial Sequence: Synthetic probe
taagtttgggtgcaagatacttggagatcgattggacgtgcccctcttctta

SEQ ID NO: 18241 - DNA, 60 bp, Artificial Sequence
  Description of Artificial Sequence: Synthetic probe
cgtggtccgctacattttcaaagacgagctatactaggtgcgcttaagtttgggtgcaag

SEQ ID NO: 18242 - DNA, 60 bp, Artificial Sequence
  Description of Artificial Sequence: Synthetic probe
atcttgcgtggtccgctacattttcaaagacgagctatactaggtgcgcttaagtttggg

SEQ ID NO: 18243 - DNA, 60 bp, Artificial Sequence
  Description of Artificial Sequence: Synthetic probe
cttgcagttagcgtgctgtcgaaaaatcgcgcgattcaagaaaaccataaggaattaatg

SEQ ID NO: 18244 - DNA, 60 bp, Artificial Sequence
  Description of Artificial Sequence: Synthetic probe
tagtctctacaattttggagtatcgcgcgagggatatcccggataatgcgcttgcagtta

SEQ ID NO: 18245 - DNA, 60 bp, Artificial Sequence
  Description of Artificial Sequence: Synthetic probe
gtgagaggacacacgcggagacaactatggtgaaagagtatcggaataagattgacgctc

SEQ ID NO: 18246 - DNA, 60 bp, Artificial Sequence
  Description of Artificial Sequence: Synthetic probe
caatcgatggtttagtacagggcagtgtacattcgatattgacaggtgagtcttacggtg

SEQ ID NO: 18247 - DNA, 60 bp, Artificial Sequence
  Description of Artificial Sequence: Synthetic probe
cacctaatcagatctacccagggtagacaaagattggaagtcattactcgctttttccct

SEQ ID NO: 18248 - DNA, 60 bp, Artificial Sequence
  Description of Artificial Sequence: Synthetic probe
ggcgggtattacgtacagttgacgaaagtagatggatcatacacctaatcagatctaccc

SEQ ID NO: 18249 - DNA, 60 bp, Artificial Sequence
  Description of Artificial Sequence: Synthetic probe
ttgagaaaaggcgggtattacgtacagttgacgaaagtagatggatcatacacctaatca

SEQ ID NO: 18250 - DNA, 60 bp, Artificial Sequence
  Description of Artificial Sequence: Synthetic probe
cacgctctgtgacgtgtcacagatcgtggttcaccttttcgatcggttttttgagaaaag

SEQ ID NO: 18251 - DNA, 60 bp, Artificial Sequence
  Description of Artificial Sequence: Synthetic probe
tttcccaaaattaatcctactgcatttgagatggaaggcacgctctgtgacgtgtcacag

SEQ ID NO: 18252 - DNA, 60 bp, Artificial Sequence
  Description of Artificial Sequence: Synthetic probe
gatatatatgaatttcccaaaattaatcctactgcatttgagatggaaggcacgctctgt

SEQ ID NO: 18253 - DNA, 60 bp, Artificial Sequence
  Description of Artificial Sequence: Synthetic probe
tctacgtgtcccattgtaactaattattttttgctggaaaagtcgtgcgttctaatcctt

SEQ ID NO: 18254 - DNA, 60 bp, Artificial Sequence
  Description of Artificial Sequence: Synthetic probe
cgcgccaatgcttaaacggcgcaacgaacatttgagttacagttctacgtgtcccattgt

SEQ ID NO: 18255 - DNA, 60 bp, Artificial Sequence
  Description of Artificial Sequence: Synthetic probe
agttatacgcgccaatgcttaaacggcgcaacgaacatttgagttacagttctacgtgtc

SEQ ID NO: 18256 - DNA, 60 bp, Artificial Sequence
  Description of Artificial Sequence: Synthetic probe
gcagagctcctcgacaatacatcaaacgttagcgcgagatgagttatacgcgccaatgct

SEQ ID NO: 18257 - DNA, 60 bp, Artificial Sequence
  Description of Artificial Sequence: Synthetic probe
agctatgaagcagagctcctcgacaatacatcaaacgttagcgcgagatgagttatacgc

SEQ ID NO: 18258 - DNA, 60 bp, Artificial Sequence
  Description of Artificial Sequence: Synthetic probe
gtagacctaaggccatctctgaaaggaatgagtttagctatgaagcagagctcctcgaca

SEQ ID NO: 18259 - DNA, 60 bp, Artificial Sequence
  Description of Artificial Sequence: Synthetic probe
cacatgtcgcattatgtagacctaaggccatctctgaaaggaatgagtttagctatgaag

SEQ ID NO: 18260 - DNA, 53 bp, Artificial Sequence
  Description of Artificial Sequence: Synthetic probe
aagcgatgatccattcgttaaaagaactctaaagcctgcacaagcagattgtg

SEQ ID NO: 18261 - DNA, 60 bp, Artificial Sequence
  Description of Artificial Sequence: Synthetic probe
cgtattccctccgtattacaataaatggacgtatgccccgatgttcaatgcgagagttaa

SEQ ID NO: 18262 - DNA, 60 bp, Artificial Sequence
  Description of Artificial Sequence: Synthetic probe
gcagatcacaaatcgtattccctccgtattacaataaatggacgtatgccccgatgttca

SEQ ID NO: 18263 - DNA, 64 bp, Artificial Sequence
  Description of Artificial Sequence: Synthetic probe
ggaaacatttaaaatgtataagatcttaagcgataacggcaatcccttattgtatgaccttgag

SEQ ID NO: 18264 - DNA, 60 bp, Artificial Sequence
  Description of Artificial Sequence: Synthetic probe
ggaaacatttaaaatgtataagatcttaagcgataacggcaatcccttattgtatgacct

SEQ ID NO: 18265 - DNA, 60 bp, Artificial Sequence
  Description of Artificial Sequence: Synthetic probe
gttaaatatagtgaaatgatacaatcgattattgatggtggatggaaacaggaaacattt

SEQ ID NO: 18266 - DNA, 60 bp, Artificial Sequence
  Description of Artificial Sequence: Synthetic probe
gcgcgaactaacctatttgatttagatgaaagaccaggagagaaggtaatacattgggaa

SEQ ID NO: 18267 - DNA, 60 bp, Artificial Sequence
  Description of Artificial Sequence: Synthetic probe
gcttcggatactaataatggacgggtgtggtggtctaacccctacccttgtcttagaggc

SEQ ID NO: 18268 - DNA, 60 bp, Artificial Sequence
  Description of Artificial Sequence: Synthetic probe
tattgatgatagctgcttcggatactaataatggacgggtgtggtggtctaacccctacc

SEQ ID NO: 18269 - DNA, 60 bp, Artificial Sequence
  Description of Artificial Sequence: Synthetic probe
cgcctcgaggagccatcggacaaatgaggaacgtttctacgtactattgatgatagctgc

SEQ ID NO: 18270 - DNA, 60 bp, Artificial Sequence
  Description of Artificial Sequence: Synthetic probe
gatcttcgcctcgaggagccatcggacaaatgaggaacgtttctacgtactattgatgat

SEQ ID NO: 18271 - DNA, 60 bp, Artificial Sequence
  Description of Artificial Sequence: Synthetic probe
gagaaattctcacaggatgattcggagaggggtgtgatcttcgcctcgaggagccatcgg

SEQ ID NO: 18272 - DNA, 60 bp, Artificial Sequence
  Description of Artificial Sequence: Synthetic probe
cagtttaaactggatgagaaattctcacaggatgattcggagaggggtgtgatcttcgcc

SEQ ID NO: 18273 - DNA, 60 bp, Artificial Sequence
  Description of Artificial Sequence: Synthetic probe
gtattgtcaagtatcggccgtaaatggttgatatggaggaggagccgaaggatgaaggca

SEQ ID NO: 18274 - DNA, 60 bp, Artificial Sequence
  Description of Artificial Sequence: Synthetic probe
gagggcgggtttgaagtgtacaccgaaggaatagtgacgcatagaatctgtaagaagagc

SEQ ID NO: 18275 - DNA, 60 bp, Artificial Sequence
  Description of Artificial Sequence: Synthetic probe
tcaaataagtgaggagggcgggtttgaagtgtacaccgaaggaatagtgacgcatagaat

SEQ ID NO: 18276 - DNA, 60 bp, Artificial Sequence
  Description of Artificial Sequence: Synthetic probe
cccgcgcgtttacgctgtgataggttgagattgcgtttcccattaagcgtacgacattta

SEQ ID NO: 18277 - DNA, 60 bp, Artificial Sequence
  Description of Artificial Sequence: Synthetic probe
ggtgtgtcggatggcgtggtttggtacctgccaatcactcatccatataaatgcgtggtc

SEQ ID NO: 18278 - DNA, 55 bp, Artificial Sequence
  Description of Artificial Sequence: Synthetic probe
ttatatgagtacaacgatatcagaggggggtgtgaattttaacgtcgtttcaact

SEQ ID NO: 18279 - DNA, 60 bp, Artificial Sequence
  Description of Artificial Sequence: Synthetic probe
acatgtacttctttccgtcattagccgatcgagcatcgaaagtagatgagtcgatgatta

SEQ ID NO: 18280 - DNA, 60 bp, Artificial Sequence
  Description of Artificial Sequence: Synthetic probe
tggtcaataccgttaatactatatacagaccaagtaaaggtgattcctctagaagtgggc

SEQ ID NO: 18281 - DNA, 60 bp, Artificial Sequence
  Description of Artificial Sequence: Synthetic probe
cctgccactactattcataacaggcgataatatgatatataagcatagacagtggtcaat

SEQ ID NO: 18282 - DNA, 60 bp, Artificial Sequence
  Description of Artificial Sequence: Synthetic probe
cgcgcgcttggtttcgaatgcgcggaggccgacttatgtaagggatcttatggtagtgaa

SEQ ID NO: 18283 - DNA, 60 bp, Artificial Sequence
  Description of Artificial Sequence: Synthetic probe
ggtgcggcgcgtatggacattctcgagttttattttccaacgttcgcgcgcttggtttcg

SEQ ID NO: 18284 - DNA, 60 bp, Artificial Sequence
  Description of Artificial Sequence: Synthetic probe
actgagactgagagggatccgcaagaggaatttactcacccaagagtcgatctgcagttt

SEQ ID NO: 18285 - DNA, 60 bp, Artificial Sequence
  Description of Artificial Sequence: Synthetic probe
agtgattactcggttcggtgtaatcaaaaaaccgacgaagccttgcgtgactttgaccgg

SEQ ID NO: 18286 - DNA, 60 bp, Artificial Sequence
  Description of Artificial Sequence: Synthetic probe
cgccctgggctgatgggtcgctcgctgatgagaacacaaactcagtcaacattcgatgcg

SEQ ID NO: 18287 - DNA, 60 bp, Artificial Sequence
  Description of Artificial Sequence: Synthetic probe
tatgatattcgccctgggctgatgggtcgctcgctgatgagaacacaaactcagtcaaca

SEQ ID NO: 18288 - DNA, 60 bp, Artificial Sequence
  Description of Artificial Sequence: Synthetic probe
gaccctgtcgagctacagagatacactttagctagatattatgatattcgccctgggctg

SEQ ID NO: 18289 - DNA, 60 bp, Artificial Sequence
  Description of Artificial Sequence: Synthetic probe
gctaaataatacttcagaggtgatattacctgactattacggcaaatggataattgctcc

SEQ ID NO: 18290 - DNA, 60 bp, Artificial Sequence
  Description of Artificial Sequence: Synthetic probe
ataagttacttcaaaagaagggtaacgttcttacaatcgatttcgaaaaagatgcgaagc

SEQ ID NO: 18291 - DNA, 60 bp, Artificial Sequence
  Description of Artificial Sequence: Synthetic probe
tatatgaacgagagcgggtgattactttagagagaggcaactcctgtgacttgtatccgg

SEQ ID NO: 18292 - DNA, 60 bp, Artificial Sequence
  Description of Artificial Sequence: Synthetic probe
cgaggctggtccgtcaagcaaggttatacactgggagtatcaattatatgaacgagagcg

SEQ ID NO: 18293 - DNA, 60 bp, Artificial Sequence
  Description of Artificial Sequence: Synthetic probe
ggagcgggaaacggaaaagtatatatttagtaagataaatttgttcgattacgaggctgg

SEQ ID NO: 18294 - DNA, 60 bp, Artificial Sequence
  Description of Artificial Sequence: Synthetic probe
gcgatcttggtatgactggagcgttagatctagctatataccacgtgagagggagcggga

SEQ ID NO: 18295 - DNA, 60 bp, Artificial Sequence
  Description of Artificial Sequence: Synthetic probe
ccgtcttaatgactcagaaaggaacaagatattcgagttcaaaacgcatagaaaagatga

SEQ ID NO: 18296 - DNA, 60 bp, Artificial Sequence
  Description of Artificial Sequence: Synthetic probe
cgcaggatttgtgtcggatactatcacgcataggaagaatcatgctagatcaagaagcgg

SEQ ID NO: 18297 - DNA, 60 bp, Artificial Sequence
  Description of Artificial Sequence: Synthetic probe
gcgattcgaaccaagtgggcagcaggtagattcgatccagttcacattaactcgcaggat

SEQ ID NO: 18298 - DNA, 60 bp, Artificial Sequence
  Description of Artificial Sequence: Synthetic probe
gggacatagggtacaaatgggagatgaagcatatgctaaactgatgggacgtctagtacg

SEQ ID NO: 18299 - DNA, 60 bp, Artificial Sequence
  Description of Artificial Sequence: Synthetic probe
aggtcagctatgtaatcatttagtgaggatggacttgttacatgcggcgcaggaaatcgc

SEQ ID NO: 18300 - DNA, 56 bp, Artificial Sequence
  Description of Artificial Sequence: Synthetic probe
atatctattgatgaagaacacagccgggttgtacattctctgtttaattgtcaggt

SEQ ID NO: 18301 - DNA, 60 bp, Artificial Sequence
  Description of Artificial Sequence: Synthetic probe
ccccaacacgaaatgacggagtggttctgccaagaattgtcgatatcagcctaagaggat

SEQ ID NO: 18302 - DNA, 60 bp, Artificial Sequence
  Description of Artificial Sequence: Synthetic probe
atgcacttaaatataccccaacacgaaatgacggagtggttctgccaagaattgtcgata

SEQ ID NO: 18303 - DNA, 60 bp, Artificial Sequence
  Description of Artificial Sequence: Synthetic probe
ggatcgcgatggatgagctcggcattccaatttatgggcgtaattatccagaacacctct

SEQ ID NO: 18304 - DNA, 60 bp, Artificial Sequence
  Description of Artificial Sequence: Synthetic probe
ttcgcgatgaacagattggcaggatcggagatcattattatacaacaaattgttacactg

SEQ ID NO: 18305 - DNA, 60 bp, Artificial Sequence
  Description of Artificial Sequence: Synthetic probe
tgtggtgaatctgggggctaccttcttgatgatggtctgtgcaaaaagtgagagaagcct

SEQ ID NO: 18306 - DNA, 60 bp, Artificial Sequence
  Description of Artificial Sequence: Synthetic probe
cggtttgcacgttatcgagcgatatgagcgtggcgtttaaattaaatggtacatcggccg

SEQ ID NO: 18307 - DNA, 60 bp, Artificial Sequence
  Description of Artificial Sequence: Synthetic probe
ttgggttttagccttacagctaccggttaatccgcaggtagtgtgggatgtgccgcgcag

SEQ ID NO: 18308 - DNA, 60 bp, Artificial Sequence
  Description of Artificial Sequence: Synthetic probe
cccagagaataacgacaactgggccatttgctattctaacaggatcaactccaaccgcac

SEQ ID NO: 18309 - DNA, 60 bp, Artificial Sequence
  Description of Artificial Sequence: Synthetic probe
tgctgtgcggttggagttgatcctgttagaatagcaaatggcccagttgtcgttattctc

SEQ ID NO: 18310 - DNA, 60 bp, Artificial Sequence
  Description of Artificial Sequence: Synthetic probe
cttccaatctggaaatctaacggctcacctgttggaccataattgacttgaactctggtg

SEQ ID NO: 18311 - DNA, 60 bp, Artificial Sequence
  Description of Artificial Sequence: Synthetic probe
tcttccaatctggaaatctaacggctcacctgttggaccataattgacttgaactctggt

SEQ ID NO: 18312 - DNA, 51 bp, Artificial Sequence
  Description of Artificial Sequence: Synthetic probe
gaggcggtgaaagcagtcatgaacttgtcgcattcgcataatttcatcaat

SEQ ID NO: 18313 - DNA, 60 bp, Artificial Sequence
  Description of Artificial Sequence: Synthetic probe
ggttcagacaggaaggtttctattacacgaatatgttagaagccccgccggaaatagatc

SEQ ID NO: 18314 - DNA, 60 bp, Artificial Sequence
  Description of Artificial Sequence: Synthetic probe
gttcagacaggaaggtttctattacacgaatatgttagaagccccaccagaaatagatcg

SEQ ID NO: 18315 - DNA, 60 bp, Artificial Sequence
  Description of Artificial Sequence: Synthetic probe
gttcagacaggaaggtttctattacacgaatatgttagaagccccgccggaaatagatcg

SEQ ID NO: 18316 - DNA, 60 bp, Artificial Sequence
  Description of Artificial Sequence: Synthetic probe
gacaggaaggtttctattacacgaatatgttagaagccccgccggaaatagatcgtgtag

SEQ ID NO: 18317 - DNA, 60 bp, Artificial Sequence
  Description of Artificial Sequence: Synthetic probe
tttgaacaccttcatattgtacgtaagaatgggttgctgcatgagagtgatgagccgcgg

SEQ ID NO: 18318 - DNA, 60 bp, Artificial Sequence
  Description of Artificial Sequence: Synthetic probe
atattgttttgatgaatcatcgaaaaggtatgagttgcaatgtgtgggtgcgtgtgagcg

SEQ ID NO: 18319 - DNA, 60 bp, Artificial Sequence
  Description of Artificial Sequence: Synthetic probe
gaagaggctaaagagatgattccgggaactagcagattggagaagctgcgtgaagcgaga

SEQ ID NO: 18320 - DNA, 55 bp, Artificial Sequence
  Description of Artificial Sequence: Synthetic probe
gggccagcgcgtcagccttatggttttttccttgaaactgaggaaaccttccaac

SEQ ID NO: 18321 - DNA, 55 bp, Artificial Sequence
  Description of Artificial Sequence: Synthetic probe
gggccagcgcgtcagccttatggttttttccttgaaactgaggagaccttccaac

SEQ ID NO: 18322 - DNA, 60 bp, Artificial Sequence
  Description of Artificial Sequence: Synthetic probe
cctcgacatgggggccggcgcgtcagccttatggttttttccttgaaactgaggagacct

SEQ ID NO: 18323 - DNA, 60 bp, Artificial Sequence
  Description of Artificial Sequence: Synthetic probe
agcaactagcggtaagtgtactgaataaaaagacagccgtagccgataactgtaatgaaa

SEQ ID NO: 18324 - DNA, 60 bp, Artificial Sequence
  Description of Artificial Sequence: Synthetic probe
cggaggaggtgcccctaattggcgcgggcatggccacagccgtagcgaccggtagagcaa

SEQ ID NO: 18325 - DNA, 60 bp, Artificial Sequence
  Description of Artificial Sequence: Synthetic probe
tgccggaatgactgcagacgtcttagaagcagcatcggaggaggtgcccctaattggcgc

SEQ ID NO: 18326 - DNA, 60 bp, Artificial Sequence
  Description of Artificial Sequence: Synthetic probe
ggcgatccaggagattgccggaatgactgcagacgtcttagaagcagcatcggaggaggt

SEQ ID NO: 18327 - DNA, 60 bp, Artificial Sequence
  Description of Artificial Sequence: Synthetic probe
gcgattgagattgagcgagatggaatgcaggaagaggcgatccaggagattgccggaatg

SEQ ID NO: 18328 - DNA, 60 bp, Artificial Sequence
  Description of Artificial Sequence: Synthetic probe
gacgcgcttaaaaatgcgattgagattgagcgagatggaatgcaggaagaggcgatccag

SEQ ID NO: 18329 - DNA, 60 bp, Artificial Sequence
  Description of Artificial Sequence: Synthetic probe
agagaagtcaagatgaaatcaaaatggtgaaggaatacagacagaagatcgacgcgctta

SEQ ID NO: 18330 - DNA, 60 bp, Artificial Sequence
  Description of Artificial Sequence: Synthetic probe
ggagggagctagaagaagtttacgacttcatgaatggtgaggcgaaagaggaggaggtag

SEQ ID NO: 18331 - DNA, 60 bp, Artificial Sequence
  Description of Artificial Sequence: Synthetic probe
gaagaaaatttattcaaccattgggaaggcagcagagcggtttgctgaaagtgagatcgg

SEQ ID NO: 18332 - DNA, 60 bp, Artificial Sequence
  Description of Artificial Sequence: Synthetic probe
gtgttctcctactcgcagaagatggggaaaataattaaatcgctaagtagatttggaaaa

SEQ ID NO: 18333 - DNA, 60 bp, Artificial Sequence
  Description of Artificial Sequence: Synthetic probe
cagggaagactccgggagcgcggattatacattgggttcaggagatgacgatgggcacga

SEQ ID NO: 18334 - DNA, 60 bp, Artificial Sequence
  Description of Artificial Sequence: Synthetic probe
ctaggtcaaaacgctgtgataagcatggaaaaccccggatacccactgtttcgcgcagga

SEQ ID NO: 18335 - DNA, 60 bp, Artificial Sequence
  Description of Artificial Sequence: Synthetic probe
acgcatgctaaagccgttgagagagggggacgcaagcagaggaagaaaacccatggtgac

SEQ ID NO: 18336 - DNA, 60 bp, Artificial Sequence
  Description of Artificial Sequence: Synthetic probe
ggttccttgcactacgatatttccttttcggatctgcgtggaaacgctcagagaattgtt

SEQ ID NO: 18337 - DNA, 60 bp, Artificial Sequence
  Description of Artificial Sequence: Synthetic probe
atttaggttccttgcactacgatatttccttttcggatctgcgtggaaacgctcagagaa

SEQ ID NO: 18338 - DNA, 60 bp, Artificial Sequence
  Description of Artificial Sequence: Synthetic probe
tttatttaggttccttgcattacgatatttccttttcggatctgcgtggaaacgctcaga

SEQ ID NO: 18339 - DNA, 60 bp, Artificial Sequence
  Description of Artificial Sequence: Synthetic probe
atttacttaggttccttgcactacgatatttccttttcggatctgcgtggaaacgctcag

SEQ ID NO: 18340 - DNA, 60 bp, Artificial Sequence
  Description of Artificial Sequence: Synthetic probe
tgaggtagaaagagatggcatgcaagaggaggcaatacaggagattgcggggatgaccgc

SEQ ID NO: 18341 - DNA, 60 bp, Artificial Sequence
  Description of Artificial Sequence: Synthetic probe
tttggaaaaaaggtcgggaatgctttgacttcgaatacagcgaaaaagatttactcaacg

SEQ ID NO: 18342 - DNA, 60 bp, Artificial Sequence
  Description of Artificial Sequence: Synthetic probe
gcctaacatgctgccaccaattttcccaccaaatgatcgtgatagtatcttaacccttct

SEQ ID NO: 18343 - DNA, 60 bp, Artificial Sequence
  Description of Artificial Sequence: Synthetic probe
ctgcctaacatgctgccaccaattttcccaccaaatgatcgtgatagtatcttaaccctt

SEQ ID NO: 18344 - DNA, 60 bp, Artificial Sequence
  Description of Artificial Sequence: Synthetic probe
aaacccaagcaggtgtgaccgttagcgttggtggagttgacatgagagcgggacgcatta

SEQ ID NO: 18345 - DNA, 60 bp, Artificial Sequence
  Description of Artificial Sequence: Synthetic probe
cgaaaactttgcgatggcgcaaggtaattcacagcaaacccaagcaggtgtgaccgttag

SEQ ID NO: 18346 - DNA, 60 bp, Artificial Sequence
  Description of Artificial Sequence: Synthetic probe
ggtatggagaagaatcgaaaactttgcgatggcgcaaggtaattcacagcaaacccaagc

SEQ ID NO: 18347 - DNA, 55 bp, Artificial Sequence
  Description of Artificial Sequence: Synthetic probe
ttttccttgaaactgaggagacttttcaacctggaagatggttcatgcgcgccgc

SEQ ID NO: 18348 - DNA, 60 bp, Artificial Sequence
  Description of Artificial Sequence: Synthetic probe
caggtacaatggactaactctacgtggggtaacgatgcgcccgacctcgttggcgcaaag

SEQ ID NO: 18349 - DNA, 60 bp, Artificial Sequence
  Description of Artificial Sequence: Synthetic probe
tagcaatcaacaggtacaatggactaactctacgtggggtaacgatgcgcccgacctcgt

SEQ ID NO: 18350 - DNA, 60 bp, Artificial Sequence
  Description of Artificial Sequence: Synthetic probe
accagtcaaagagggtcaaattgtgaatccaacatttatatcaagatatcgccaaattgc

SEQ ID NO: 18351 - DNA, 60 bp, Artificial Sequence
  Description of Artificial Sequence: Synthetic probe
agcggagataccgcagtggtttaagagtttaaatcccatgcttggagtggtaaatctagg

SEQ ID NO: 18352 - DNA, 60 bp, Artificial Sequence
  Description of Artificial Sequence: Synthetic probe
gacgttgttagttgccgctgtcgtagcgctgttgacgtcggtgtgcacgctttcaagtga

SEQ ID NO: 18353 - DNA, 60 bp, Artificial Sequence
  Description of Artificial Sequence: Synthetic probe
gtagaggttggcgcgtacgcaaatagatttggattcaaaagttttatgaactttacacgg

SEQ ID NO: 18354 - DNA, 60 bp, Artificial Sequence
  Description of Artificial Sequence: Synthetic probe
agcaccattggaattgaccactgtctatgcgaatacgagatgttatcatgaacaaggaac

SEQ ID NO: 18355 - DNA, 59 bp, Artificial Sequence
  Description of Artificial Sequence: Synthetic probe
tcccaccagtcgacggatgcacatatgtttgatgttccataccttcatgtagatccgga

SEQ ID NO: 18356 - DNA, 60 bp, Artificial Sequence
  Description of Artificial Sequence: Synthetic probe
gcggattgttcctgttttaagctcaacgcctcgccaaaaaatagtagccgcagatcgtag

SEQ ID NO: 18357 - DNA, 60 bp, Artificial Sequence
  Description of Artificial Sequence: Synthetic probe
cggccttagactccatctatacacacgtcggagtgtactgtaaacgtcacccaattcaca

SEQ ID NO: 18358 - DNA, 60 bp, Artificial Sequence
  Description of Artificial Sequence: Synthetic probe
ccatctatacacacgtcggagtgtactgtaaacgtcacccaattcacactcagctgcaac

SEQ ID NO: 18359 - DNA, 60 bp, Artificial Sequence
  Description of Artificial Sequence: Synthetic probe
ggtgtaagagccccagcgacagatgaaggaagattttacgctctgattgcaatcgcagcg

SEQ ID NO: 18360 - DNA, 60 bp, Artificial Sequence
  Description of Artificial Sequence: Synthetic probe
tgaagagccgaaagatgaaatggatctatcaacaagatttcagttcaaacttgacgaaaa

SEQ ID NO: 18361 - DNA, 60 bp, Artificial Sequence
  Description of Artificial Sequence: Synthetic probe
cgcgaataggcaatagtggattaccttatgaacggtttatctcaagtatggtccaggtga

SEQ ID NO: 18362 - DNA, 60 bp, Artificial Sequence
  Description of Artificial Sequence: Synthetic probe
ctggtttataattcatcgcctctacaattgttaatcttggtatatctatcatatcggatt

SEQ ID NO: 18363 - DNA, 60 bp, Artificial Sequence
  Description of Artificial Sequence: Synthetic probe
ggatcaacagccgcttaagatatcgattgacgaggaacatagccgggttgtgcactccct

SEQ ID NO: 18364 - DNA, 60 bp, Artificial Sequence
  Description of Artificial Sequence: Synthetic probe
cgctaaccgaagcgtataaagagttcttaaatttggccatttctagcacgtatgggacgc

SEQ ID NO: 18365 - DNA, 60 bp, Artificial Sequence
  Description of Artificial Sequence: Synthetic probe
tagcggggatgactgctgatgtcttagaggcggcatctgaagaggtgcctctgatcggag

SEQ ID NO: 18366 - DNA, 60 bp, Artificial Sequence
  Description of Artificial Sequence: Synthetic probe
tatatgagtttatgagtggtgcggcaaaagaagaggcgggggatgagaagcagttcgata

SEQ ID NO: 18367 - DNA, 60 bp, Artificial Sequence
  Description of Artificial Sequence: Synthetic probe
gcttatcgctgctgtcgttgcactgttaacatcggtatgtacgctgtcaagtgacatgag

SEQ ID NO: 18368 - DNA, 60 bp, Artificial Sequence
  Description of Artificial Sequence: Synthetic probe
ggagagaattgaagagctgagtctggttcgcgtggatgatacgatttcacagccaccgag

SEQ ID NO: 18369 - DNA, 60 bp, Artificial Sequence
  Description of Artificial Sequence: Synthetic probe
taatcaggagagaattgaagagctgagtctggttcgcgtggatgatacgatttcacagcc

SEQ ID NO: 18370 - DNA, 51 bp, Artificial Sequence
  Description of Artificial Sequence: Synthetic probe
cactctttctaaaaaacgcgtgactgcggtgatcccggaacttctacttac

SEQ ID NO: 18371 - DNA, 54 bp, Artificial Sequence
  Description of Artificial Sequence: Synthetic probe
tgccactctttctaaaaaacgcgtgactgcggtgatcccgggacttctacttac

SEQ ID NO: 18372 - DNA, 60 bp, Artificial Sequence
  Description of Artificial Sequence: Synthetic probe
cgagacgtatgattagatctaaaactgtccaccctatctacctaggttcgatgcactatg

SEQ ID NO: 18373 - DNA, 60 bp, Artificial Sequence
  Description of Artificial Sequence: Synthetic probe
cgagacgtatgattagatctaaaactgtccaccctatctacttaggctcgatgcactatg

SEQ ID NO: 18374 - DNA, 60 bp, Artificial Sequence
  Description of Artificial Sequence: Synthetic probe
atgcgagacgtatgattagatctaaaactgtccaccctatctacctaggttcgatgcact

SEQ ID NO: 18375 - DNA, 60 bp, Artificial Sequence
  Description of Artificial Sequence: Synthetic probe
cactcggggctgctcaggaggcgaagggacgtactctaaacgaggcgtacaaggaatttc

SEQ ID NO: 18376 - DNA, 60 bp, Artificial Sequence
  Description of Artificial Sequence: Synthetic probe
cgctcggggctgctcaggaagcaaagggacgtactctaaacgaggcgtacaaggaatttc

SEQ ID NO: 18377 - DNA, 60 bp, Artificial Sequence
  Description of Artificial Sequence: Synthetic probe
gcactcggggctgctcaggaggcgaagggacgtactctaaacgaggcgtacaaggaattt

SEQ ID NO: 18378 - DNA, 60 bp, Artificial Sequence
  Description of Artificial Sequence: Synthetic probe
gggttatgatgaggttcaaagtgccacgatcgcagcagcctcagatccatatctatagcg

SEQ ID NO: 18379 - DNA, 60 bp, Artificial Sequence
  Description of Artificial Sequence: Synthetic probe
gaatacacccaagggttatgatgaggttcaaagtgccacgatcgcagcaacctcagatcc

SEQ ID NO: 18380 - DNA, 60 bp, Artificial Sequence
  Description of Artificial Sequence: Synthetic probe
attgatgataagagaatacacccaagggttatgatgaggttcaaagtgccacgatcgcag

SEQ ID NO: 18381 - DNA, 53 bp, Artificial Sequence
  Description of Artificial Sequence: Synthetic probe
gcaattgtggcgaatacgagggaagttcagcacataaaggaggaaattctgcc

SEQ ID NO: 18382 - DNA, 60 bp, Artificial Sequence
  Description of Artificial Sequence: Synthetic probe
ggtcgcaaccaccttagaacacagatttagagatatacctgataaagagctagcagtcag

SEQ ID NO: 18383 - DNA, 60 bp, Artificial Sequence
  Description of Artificial Sequence: Synthetic probe
acgatggtcgcaaccaccttagaacacagatttagagatatacctgataaagagctagca

SEQ ID NO: 18384 - DNA, 60 bp, Artificial Sequence
  Description of Artificial Sequence: Synthetic probe
agcccaccatgttcgcgaccaccttagaacacagatttagagatatacctgataaggagc

SEQ ID NO: 18385 - DNA, 60 bp, Artificial Sequence
  Description of Artificial Sequence: Synthetic probe
ttcgctgagagtgaaatcgggtcggctgcaattgatgggttagttcagggtagcgttcac

SEQ ID NO: 18386 - DNA, 60 bp, Artificial Sequence
  Description of Artificial Sequence: Synthetic probe
gagaaggttgcgaagcagattaaattgaaggatgagcggttcatgagtttatcaagcgct

SEQ ID NO: 18387 - DNA, 60 bp, Artificial Sequence
  Description of Artificial Sequence: Synthetic probe
aaggaatacattgagaaggttgcgaagcagattaaattgaaggatgagcggttcatgagt

SEQ ID NO: 18388 - DNA, 60 bp, Artificial Sequence
  Description of Artificial Sequence: Synthetic probe
ggagcaggtgaagaccttgagtgatgatgacgaacaaggtgaggatgcgagtgacgacga

SEQ ID NO: 18389 - DNA, 60 bp, Artificial Sequence
  Description of Artificial Sequence: Synthetic probe
tgaacgagaggatgaggagcaggtgaagaccttgagtgatgatgacgaacaaggtgagga

SEQ ID NO: 18390 - DNA, 60 bp, Artificial Sequence
  Description of Artificial Sequence: Synthetic probe
cgagagtcagcgccacggcttcaagttcaaagcgtggcgccaggggaagaatcacgctgg

SEQ ID NO: 18391 - DNA, 60 bp, Artificial Sequence
  Description of Artificial Sequence: Synthetic probe
gcggaatgattttgaccggaacgagatgcccgatctaccaggtgtgatgaggtcaaatta

SEQ ID NO: 18392 - DNA, 59 bp, Artificial Sequence
  Description of Artificial Sequence: Synthetic probe
gtaggtagagtggcgccccaaggtttgcaccgcatggagtggttgatccagcgatgcaa

SEQ ID NO: 18393 - DNA, 60 bp, Artificial Sequence
  Description of Artificial Sequence: Synthetic probe
gtaggtagagtggcgccccaaggtttgcaccgcatggagtggttgatccagcgatgcaaa

SEQ ID NO: 18394 - DNA, 59 bp, Artificial Sequence
  Description of Artificial Sequence: Synthetic probe
agtacgattgggagggcagcggaaagatgcgctgaaagtgaaattggatcagcggctat

SEQ ID NO: 18395 - DNA, 60 bp, Artificial Sequence
  Description of Artificial Sequence: Synthetic probe
cagcaaattgatatggtcagaaaagagattatgaagaaacagtcatataatgatgctgta

SEQ ID NO: 18396 - DNA, 60 bp, Artificial Sequence
  Description of Artificial Sequence: Synthetic probe
gtgcgacattcctgatgatggtttgtgcgagaagcgagagaggcttgaatcagcaaattg

SEQ ID NO: 18397 - DNA, 60 bp, Artificial Sequence
  Description of Artificial Sequence: Synthetic probe
aagtttaaatccaatgctaggagtagtgaatttaggtgcgacattcctgatgatggtttg

SEQ ID NO: 18398 - DNA, 60 bp, Artificial Sequence
  Description of Artificial Sequence: Synthetic probe
acccgcttggtttaaaagtttaaatccaatgctaggagtagtgaatttaggtgcgacatt

SEQ ID NO: 18399 - DNA, 60 bp, Artificial Sequence
  Description of Artificial Sequence: Synthetic probe
cgtttcgtgatgatgtaagattaaggcagattaaacgtcatgtaaatgagcagatcttac

SEQ ID NO: 18400 - DNA, 60 bp, Artificial Sequence
  Description of Artificial Sequence: Synthetic probe
tgaatcgaggacggaagaacagagtttggtacgtgttggagaacggctctcgctcccacc

SEQ ID NO: 18401 - DNA, 60 bp, Artificial Sequence
  Description of Artificial Sequence: Synthetic probe
ccgggctgatccaaaggttcgaggaagaaaagatgaaacgtactgaatcgaggacggaag

SEQ ID NO: 18402 - DNA, 60 bp, Artificial Sequence
  Description of Artificial Sequence: Synthetic probe
atgctatccgggctgatccaaaggttcgaggaagaaaagatgaaacgtactgaatcgagg

SEQ ID NO: 18403 - DNA, 60 bp, Artificial Sequence
  Description of Artificial Sequence: Synthetic probe
gagctacagatgcatattctgagaggaccattgcattttcaacgtcgagctatattgggg

SEQ ID NO: 18404 - DNA, 60 bp, Artificial Sequence
  Description of Artificial Sequence: Synthetic probe
cgagagcagttcaccctatatttcttggctcgatgcactatgatgttacgtacgaggttc

SEQ ID NO: 18405 - DNA, 60 bp, Artificial Sequence
  Description of Artificial Sequence: Synthetic probe
gctgctccctgggattccgacgaggttttcttcttccactgcgtgtcacatcaccaccgt

SEQ ID NO: 18406 - DNA, 60 bp, Artificial Sequence
  Description of Artificial Sequence: Synthetic probe
ggcgatccaagaaatagcgggaatgactgccgacgttttagaggcggcgtcagaagaggt

SEQ ID NO: 18407 - DNA, 60 bp, Artificial Sequence
  Description of Artificial Sequence: Synthetic probe
gatgcgctgaagaatgcgattgaggtcgaacgtgacggaatgcaagaggaggcgatccaa

SEQ ID NO: 18408 - DNA, 60 bp, Artificial Sequence
  Description of Artificial Sequence: Synthetic probe
gtctacgtcgtgcagggtggttgacctcgcggcgtaaattcccactgctgtataacgggg

SEQ ID NO: 18409 - DNA, 50 bp, Artificial Sequence
  Description of Artificial Sequence: Synthetic probe
acatattgcgtggacccatacactttcaaagacgtacaatcgttgcggca

SEQ ID NO: 18410 - DNA, 60 bp, Artificial Sequence
  Description of Artificial Sequence: Synthetic probe
ccgatttatttaggaatgcatgattatgaagtttcgtacgctcaaatgaagatgaacgcg

SEQ ID NO: 18411 - DNA, 60 bp, Artificial Sequence
  Description of Artificial Sequence: Synthetic probe
tccagaagtaaccatccgatttatttaggaatgcatgattatgaagtttcgtacgctcaa

SEQ ID NO: 18412 - DNA, 60 bp, Artificial Sequence
  Description of Artificial Sequence: Synthetic probe
gtcgcaggacaaacagcaatccatcagcgtaggttgctaagatccagaagtaaccatccg

SEQ ID NO: 18413 - DNA, 60 bp, Artificial Sequence
  Description of Artificial Sequence: Synthetic probe
gcagaactttccgtgaggcgtataaggagttcttcttacttgcctctaacgtcgcaggac

SEQ ID NO: 18414 - DNA, 60 bp, Artificial Sequence
  Description of Artificial Sequence: Synthetic probe
tgcggctccctgggactcggatgaagttttcatctttcatgtaatttcacctcatcataa

SEQ ID NO: 18415 - DNA, 60 bp, Artificial Sequence
  Description of Artificial Sequence: Synthetic probe
gcgcaacggtttaagataccacagacgcagaagccttcgatgcacatatatgcggctccc

SEQ ID NO: 18416 - DNA, 53 bp, Artificial Sequence
  Description of Artificial Sequence: Synthetic probe
aaagaaagcggttgaggaggataaagaaaacattacggattggtctgaaaagc

SEQ ID NO: 18417 - DNA, 60 bp, Artificial Sequence
  Description of Artificial Sequence: Synthetic probe
ctgaagttgatcacatacagaacgtcatcgttccgaagctaaagaaagcggttgaggagg

SEQ ID NO: 18418 - DNA, 60 bp, Artificial Sequence
  Description of Artificial Sequence: Synthetic probe
ctcgatgtaccaaaaggtgtagatattccagatctgcgtttaacggagggactcatcgcg

SEQ ID NO: 18419 - DNA, 60 bp, Artificial Sequence
  Description of Artificial Sequence: Synthetic probe
ggcgcatataagattaaggctgtaattagtgcattaaccggcatagatttaactcatctt

SEQ ID NO: 18420 - DNA, 60 bp, Artificial Sequence
  Description of Artificial Sequence: Synthetic probe
cgggcgtagctacgagcatcgcgacggcgagggcgatagaaggcgcatataagattaagg

SEQ ID NO: 18421 - DNA, 54 bp, Artificial Sequence
  Description of Artificial Sequence: Synthetic probe
agatgataagtgaataccgtgataaaattgatgcgttgcgaagtgcaattgagg

SEQ ID NO: 18422 - DNA, 60 bp, Artificial Sequence
  Description of Artificial Sequence: Synthetic probe
gtatgtcgaatcgacggagcggacggaagaagaaactaagatgataagtgaataccgtga

SEQ ID NO: 18423 - DNA, 60 bp, Artificial Sequence
  Description of Artificial Sequence: Synthetic probe
gaagaaagcgttgtatgtcgaatcgacggagcggacggaagaagaaactaagatgataag

SEQ ID NO: 18424 - DNA, 60 bp, Artificial Sequence
  Description of Artificial Sequence: Synthetic probe
caagaacataaagttggcgagcatgaagaagatcaaataaaaatgctggagaaggcgcta

SEQ ID NO: 18425 - DNA, 60 bp, Artificial Sequence
  Description of Artificial Sequence: Synthetic probe
cggaaacgatttggatgaagtgtacaaatttgcaacacaagaacataaagttggcgagca

SEQ ID NO: 18426 - DNA, 52 bp, Artificial Sequence
  Description of Artificial Sequence: Synthetic probe
ggggagatacgattgcggacccactaagccccggagagaatgagatatatag

SEQ ID NO: 18427 - DNA, 60 bp, Artificial Sequence
  Description of Artificial Sequence: Synthetic probe
ggttattctaaatgtcttaggagggggagatacgattgcggacccactaagccccggaga

SEQ ID NO: 18428 - DNA, 60 bp, Artificial Sequence
  Description of Artificial Sequence: Synthetic probe
acaggtgattcgtatggtgaaagtgtgaagcaagcggttattctaaatgtcttaggaggg

SEQ ID NO: 18429 - DNA, 60 bp, Artificial Sequence
  Description of Artificial Sequence: Synthetic probe
gttcactcaataatgacaggtgattcgtatggtgaaagtgtgaagcaagcggttattcta

SEQ ID NO: 18430 - DNA, 60 bp, Artificial Sequence
  Description of Artificial Sequence: Synthetic probe
gcaaaagatttacaggacgatcggaagtgcggctgaaaggtttgctgagagtgagattgg

SEQ ID NO: 18431 - DNA, 59 bp, Artificial Sequence
  Description of Artificial Sequence: Synthetic probe
aaaaggtaggcaatgcgttgacttcgaagacggcgcaaaagatttacaggacgatcgga

SEQ ID NO: 18432 - DNA, 60 bp, Artificial Sequence
  Description of Artificial Sequence: Synthetic probe
ctggggaagttcgggaaaaaggtaggcaatgcgttgacttcgaagacggcgcaaaagatt

SEQ ID NO: 18433 - DNA, 60 bp, Artificial Sequence
  Description of Artificial Sequence: Synthetic probe
gtagccaccaaacatcgcatgatggggaagatcattaaatcgctggggaagttcgggaaa

SEQ ID NO: 18434 - DNA, 60 bp, Artificial Sequence
  Description of Artificial Sequence: Synthetic probe
caacaaaagaattgttgagcgagtgagagttggacaaatcctagctgtattgaatagaag

SEQ ID NO: 18435 - DNA, 60 bp, Artificial Sequence
  Description of Artificial Sequence: Synthetic probe
gctcctccagagattgatcgcgttgttcaatacacatatgaaattgcgcgacttcaggcc

SEQ ID NO: 18436 - DNA, 60 bp, Artificial Sequence
  Description of Artificial Sequence: Synthetic probe
gctgactgatcaagtatatatgcatagagacatgctcccagagcctcggcttgatgacat

SEQ ID NO: 18437 - DNA, 60 bp, Artificial Sequence
  Description of Artificial Sequence: Synthetic probe
ggtcatgttaccttcgttacaaccgtcacttaaactggcattggaagaagaggcttgggc

SEQ ID NO: 18438 - DNA, 60 bp, Artificial Sequence
  Description of Artificial Sequence: Synthetic probe
tctttcgttgatgcagaggagattcccagacgtcctaattcaagcaagaccgtctcattt

SEQ ID NO: 18439 - DNA, 60 bp, Artificial Sequence
  Description of Artificial Sequence: Synthetic probe
cgcatcgtaatgagatgttagaagtggccccattaattgagtccgtttatgcgtcggagt

SEQ ID NO: 18440 - DNA, 60 bp, Artificial Sequence
  Description of Artificial Sequence: Synthetic probe
tgttacgcatgctggtcgccgcaggtaaggattcagaggctgcgtattttcgcagtatgt

SEQ ID NO: 18441 - DNA, 60 bp, Artificial Sequence
  Description of Artificial Sequence: Synthetic probe
cggtgcatgttccgaaccagtttatcgcatatataacagattgcaaggctacatagaagc

SEQ ID NO: 18442 - DNA, 60 bp, Artificial Sequence
  Description of Artificial Sequence: Synthetic probe
ggagatgtgctgtcgagtgactcaggtccgttgctatcagtgttcgcgttacaagagatc

SEQ ID NO: 18443 - DNA, 60 bp, Artificial Sequence
  Description of Artificial Sequence: Synthetic probe
cgccttatttagaaggagatgtgctgtcgagtgactcaggtccgttgctatcagtgttcg

SEQ ID NO: 18444 - DNA, 60 bp, Artificial Sequence
  Description of Artificial Sequence: Synthetic probe
ggccgtaactgctgtggtgtgtggcccagacatgatccaagtgtcattgaatgctggtgc

SEQ ID NO: 18445 - DNA, 60 bp, Artificial Sequence
  Description of Artificial Sequence: Synthetic probe
ggccgtaactgctgtggtgtgtggcccagacatgatccaagtgccattgaatgctggtgc

SEQ ID NO: 18446 - DNA, 60 bp, Artificial Sequence
  Description of Artificial Sequence: Synthetic probe
aggccgtaactgctgtggtgtgtggcccagacatgatccaagtgccattgaatgctggtg

SEQ ID NO: 18447 - DNA, 60 bp, Artificial Sequence
  Description of Artificial Sequence: Synthetic probe
aggccgtaactgctgtggtgtgtggcccagacatgatccaagtgtcattgaatgctggtg

SEQ ID NO: 18448 - DNA, 60 bp, Artificial Sequence
  Description of Artificial Sequence: Synthetic probe
agcgatatgagtgtggcctttaagataaacggaactaagacagaagtgccttcatggttt

SEQ ID NO: 18449 - DNA, 60 bp, Artificial Sequence
  Description of Artificial Sequence: Synthetic probe
catccgcgggtgatgatgaggttcaaaattcctagaacgcagcaaccgcaaattcacatt

SEQ ID NO: 18450 - DNA, 60 bp, Artificial Sequence
  Description of Artificial Sequence: Synthetic probe
tcatccgcgagtgatgatgaggttcaaaattcctagaacgcagcaaccgcaaattcacat

SEQ ID NO: 18451 - DNA, 60 bp, Artificial Sequence
  Description of Artificial Sequence: Synthetic probe
aaagtgattcatccgcgtgtgatgatgaggttcaaaattcctagaacgcagcaaccgcaa

SEQ ID NO: 18452 - DNA, 60 bp, Artificial Sequence
  Description of Artificial Sequence: Synthetic probe
ataaagtgattcatccgcgagtgatgatgaggttcaaaattcctagaacgcagcaaccgc

SEQ ID NO: 18453 - DNA, 60 bp, Artificial Sequence
  Description of Artificial Sequence: Synthetic probe
gaggataaagtgattcatccgcgtgtgatgatgaggttcaaaattcctagaacgcagcaa

SEQ ID NO: 18454 - DNA, 60 bp, Artificial Sequence
  Description of Artificial Sequence: Synthetic probe
gcgcacctgacatgcgagagtgggcagttaaggaaagcggtaacacgatatgtatactca

SEQ ID NO: 18455 - DNA, 60 bp, Artificial Sequence
  Description of Artificial Sequence: Synthetic probe
cagcatccacttcaacttctgaatacgatcacattgccaaccaacgaggacctttttctg

SEQ ID NO: 18456 - DNA, 60 bp, Artificial Sequence
  Description of Artificial Sequence: Synthetic probe
ccgtctgatggcctttgtaaggatcgatggacagtggcagattgccaatccggacaaatt

SEQ ID NO: 18457 - DNA, 60 bp, Artificial Sequence
  Description of Artificial Sequence: Synthetic probe
ctccgtgggccaatacactttcagagacgtgcaatactaggggctttgaaatttggatgt

SEQ ID NO: 18458 - DNA, 60 bp, Artificial Sequence
  Description of Artificial Sequence: Synthetic probe
gcacatactccgtgggccaatacactttcagagacgtgcaatactaggggctttgaaatt

SEQ ID NO: 18459 - DNA, 60 bp, Artificial Sequence
  Description of Artificial Sequence: Synthetic probe
ctgactgaagcgtatagagagtttctaaatttggcgatctcaaatgcatttggcacgcaa

SEQ ID NO: 18460 - DNA, 60 bp, Artificial Sequence
  Description of Artificial Sequence: Synthetic probe
taacgctctagctgttagtgttctatcaaaaaatcgcgcgattcaagaaaaccacaaaga

SEQ ID NO: 18461 - DNA, 60 bp, Artificial Sequence
  Description of Artificial Sequence: Synthetic probe
cgctctaagcgggatcgatttaacgcatttgcgcaccccgaaaatcgaacctagtgttgt

SEQ ID NO: 18462 - DNA, 60 bp, Artificial Sequence
  Description of Artificial Sequence: Synthetic probe
agcgacaggaagagctatagagggagcatataaactcaaaaaggtgattaacgctctaag

SEQ ID NO: 18463 - DNA, 60 bp, Artificial Sequence
  Description of Artificial Sequence: Synthetic probe
gttccgctgattggtgcggggatggctacggctgtagcgacaggaagagctatagaggga

SEQ ID NO: 18464 - DNA, 60 bp, Artificial Sequence
  Description of Artificial Sequence: Synthetic probe
aagaggaagcaatacaggagattgcggggatgaccgcggatgtgttagaggcggcatcgg

SEQ ID NO: 18465 - DNA, 60 bp, Artificial Sequence
  Description of Artificial Sequence: Synthetic probe
ggagaaagaacacatgcggagacggtcatggtgaaagaataccgagataaaattgatgct

SEQ ID NO: 18466 - DNA, 60 bp, Artificial Sequence
  Description of Artificial Sequence: Synthetic probe
gccgatttggcaagaaggtgggcaacgcgttaacctctaataccgcaaaaaagatctata

SEQ ID NO: 18467 - DNA, 60 bp, Artificial Sequence
  Description of Artificial Sequence: Synthetic probe
gcgcagaggattgtatatgatgatgagttgcaaatgcacatattaaggggtccgttgcat

SEQ ID NO: 18468 - DNA, 60 bp, Artificial Sequence
  Description of Artificial Sequence: Synthetic probe
cttaaatttagcaatcggtagtacctatacttctccaatgcacgcccgacgtatgattcg

SEQ ID NO: 18469 - DNA, 60 bp, Artificial Sequence
  Description of Artificial Sequence: Synthetic probe
gtagttcattttgaggatttggcggcccattggcacgctttaggcgcggcgcaggaagct

SEQ ID NO: 18470 - DNA, 60 bp, Artificial Sequence
  Description of Artificial Sequence: Synthetic probe
ccacccaagagtaatgatgaggttcaaagtgccacggtcgcaacagccgcaaatacacat

SEQ ID NO: 18471 - DNA, 60 bp, Artificial Sequence
  Description of Artificial Sequence: Synthetic probe
caagaaggtaatggatgaagaaaaagagcttgaaggaattgatgataagaagatccaccc

SEQ ID NO: 18472 - DNA, 60 bp, Artificial Sequence
  Description of Artificial Sequence: Synthetic probe
gcaaacacgagagagatccagcatattaaagaggagattttaccaaagttcaagaaggta

SEQ ID NO: 18473 - DNA, 60 bp, Artificial Sequence
  Description of Artificial Sequence: Synthetic probe
gcgtacaccgaagatagaacctacgatggttgcgactacgttggaacatagatttgaaga

SEQ ID NO: 18474 - DNA, 60 bp, Artificial Sequence
  Description of Artificial Sequence: Synthetic probe
agcggcttcagaggaagtacctttagttggttcggggatggcgaccgcgattgcaacagg

SEQ ID NO: 18475 - DNA, 60 bp, Artificial Sequence
  Description of Artificial Sequence: Synthetic probe
caggaggaagcgattcaagaaattgctggaatgacagcggatgtgttggaagcggcttca

SEQ ID NO: 18476 - DNA, 60 bp, Artificial Sequence
  Description of Artificial Sequence: Synthetic probe
ctgaaaatgacaagatgcacatattagctcgtgcattacagagggaggcagctgaaagga

SEQ ID NO: 18477 - DNA, 60 bp, Artificial Sequence
  Description of Artificial Sequence: Synthetic probe
ggcggcggaaaggttcgcggagagtgagattgggtccgcggcaattgatggactagttca

SEQ ID NO: 18478 - DNA, 60 bp, Artificial Sequence
  Description of Artificial Sequence: Synthetic probe
gtatgtgagaaatttatcctgaagtataagtgtaaagtggtgttagttaagatgcccgga

SEQ ID NO: 18479 - DNA, 60 bp, Artificial Sequence
  Description of Artificial Sequence: Synthetic probe
gattcatctgtcgtctctttgcgctggcttagcggattcgattgtttacacgctgccggt

SEQ ID NO: 18480 - DNA, 60 bp, Artificial Sequence
  Description of Artificial Sequence: Synthetic probe
ttcttcaactttacgagatttcaccctggcgatgcgaaaaaacgacagaaagccgacgat

SEQ ID NO: 18481 - DNA, 60 bp, Artificial Sequence
  Description of Artificial Sequence: Synthetic probe
cggagggtggcactgatgctgatggcgaattacgaaaagttgagcccggacttgcatgaa

SEQ ID NO: 18482 - DNA, 60 bp, Artificial Sequence
  Description of Artificial Sequence: Synthetic probe
aacggttatatgtgtaagacggagcgggaggatgaagagttagtgtgcaaaattagcgaa

SEQ ID NO: 18483 - DNA, 60 bp, Artificial Sequence
  Description of Artificial Sequence: Synthetic probe
gtacaagttaggatacaaggacggacaccacctgagatagttgacgatatcgcgcggcta

SEQ ID NO: 18484 - DNA, 60 bp, Artificial Sequence
  Description of Artificial Sequence: Synthetic probe
agacgtcccaagagtagacattgtggaggccctcgccgctaagcctatgaggaatgacgg

SEQ ID NO: 18485 - DNA, 60 bp, Artificial Sequence
  Description of Artificial Sequence: Synthetic probe
ccaccaaggtatgccccgagtgcgccgatgccatcatctatgcctacggttgcccttgaa

SEQ ID NO: 18486 - DNA, 60 bp, Artificial Sequence
  Description of Artificial Sequence: Synthetic probe
ggtggtattttacgtttccatggataagacacttaaccagtaccctgcattaacggcgga

SEQ ID NO: 18487 - DNA, 60 bp, Artificial Sequence
  Description of Artificial Sequence: Synthetic probe
ggtggtattttacgtttccatggataagacacttaaccagtaccctgcactaacggcgga

SEQ ID NO: 18488 - DNA, 60 bp, Artificial Sequence
  Description of Artificial Sequence: Synthetic probe
gtggtgtggatatgagagcgggacgcataatcgcatgggacgggcaggcggtgctacaaa

SEQ ID NO: 18489 - DNA, 60 bp, Artificial Sequence
  Description of Artificial Sequence: Synthetic probe
gagtgtgggtggtgtggatatgagagcgggacgcataatcgcatgggacgggcaggcggt

SEQ ID NO: 18490 - DNA, 60 bp, Artificial Sequence
  Description of Artificial Sequence: Synthetic probe
tcgcaatgatcccatgatgatttatctagtttggagacggatcgagaacttctccatgcc

SEQ ID NO: 18491 - DNA, 60 bp, Artificial Sequence
  Description of Artificial Sequence: Synthetic probe
gtcgcaatgatcccatgatgatttatctagtttggagacggatcgagaacttctccatgc

SEQ ID NO: 18492 - DNA, 60 bp, Artificial Sequence
  Description of Artificial Sequence: Synthetic probe
agatggacactatcgcagcaagggcgctcaccgtaatgcgggcatgtgccaccttacaag

SEQ ID NO: 18493 - DNA, 60 bp, Artificial Sequence
  Description of Artificial Sequence: Synthetic probe
gccgaaatacctcaatggtttaagagtttgaatccaatgttgggtgtggtgaatctgggg

SEQ ID NO: 18494 - DNA, 60 bp, Artificial Sequence
  Description of Artificial Sequence: Synthetic probe
acatcggccgaaatacctcaatggtttaagagtttgaatccaatgttgggtgtggtgaat

SEQ ID NO: 18495 - DNA, 60 bp, Artificial Sequence
  Description of Artificial Sequence: Synthetic probe
tatcaaacgcttatgggacgcaaatgcatacgaggaggttggtgagatcaaagatggtgc

SEQ ID NO: 18496 - DNA, 60 bp, Artificial Sequence
  Description of Artificial Sequence: Synthetic probe
gatatgcgggatagaagataaaaccatacatccgaaggttatgatgagattcaagatccc

SEQ ID NO: 18497 - DNA, 60 bp, Artificial Sequence
  Description of Artificial Sequence: Synthetic probe
ttgagcggaattgatttaacgcatttgcgcacgcctaaaatagagccaagtgtagtttct

SEQ ID NO: 18498 - DNA, 54 bp, Artificial Sequence
  Description of Artificial Sequence: Synthetic probe
gggcatggctaccgcggttgcaacaggaagggcgattgagggagcttataagct

SEQ ID NO: 18499 - DNA, 59 bp, Artificial Sequence
  Description of Artificial Sequence: Synthetic probe
gtgaatcatatggcgaatccgttaaacaggcagtcttactgaatgttttaggtagtggt

SEQ ID NO: 18500 - DNA, 60 bp, Artificial Sequence
  Description of Artificial Sequence: Synthetic probe
cgggaaggcggccgaaagatttgcggagagcgaaattggatcggcagcaattgatgggct

SEQ ID NO: 18501 - DNA, 60 bp, Artificial Sequence
  Description of Artificial Sequence: Synthetic probe
cccgtcaaaatgtttagttgcctttgaagtggcggatgacgttgtgccatactcagtccg

SEQ ID NO: 18502 - DNA, 60 bp, Artificial Sequence
  Description of Artificial Sequence: Synthetic probe
ggctgcgcttgaggattatcgggacgttatatcaaggcgtttagggtatgttgaacgtga

SEQ ID NO: 18503 - DNA, 60 bp, Artificial Sequence
  Description of Artificial Sequence: Synthetic probe
cagtggagtgtcaggccaacttataccccgtacgataggagcagagaaagcgacgaatac

SEQ ID NO: 18504 - DNA, 60 bp, Artificial Sequence
  Description of Artificial Sequence: Synthetic probe
taagagtctaaatcccatgcttggagtagtgaatctgggtgcgactttcattatgatggt

SEQ ID NO: 18505 - DNA, 60 bp, Artificial Sequence
  Description of Artificial Sequence: Synthetic probe
aaacagttcacccgatctacctaggatccatgcattatgacatcacttatgagacgttga

SEQ ID NO: 18506 - DNA, 59 bp, Artificial Sequence
  Description of Artificial Sequence: Synthetic probe
gcgtgtgcaggttaattatggccctacgggggagccgttggatttccatatcggcagga

SEQ ID NO: 18507 - DNA, 60 bp, Artificial Sequence
  Description of Artificial Sequence: Synthetic probe
acttcgctgggttcgctgcgcctgcgtgtgaaggcggggaagtaattaatcttgctgcgg

SEQ ID NO: 18508 - DNA, 60 bp, Artificial Sequence
  Description of Artificial Sequence: Synthetic probe
actacgctgggttcgctgcgcctgcgtgtgaaggcggggaagtaattaatcttgctgcgc

SEQ ID NO: 18509 - DNA, 60 bp, Artificial Sequence
  Description of Artificial Sequence: Synthetic probe
acttcgctgggttcgctgcgcctgcgtgtgaaggcggggaagtaattaatcttgctgcgc

SEQ ID NO: 18510 - DNA, 60 bp, Artificial Sequence
  Description of Artificial Sequence: Synthetic probe
tgcagaaaaagttcacttcgctgggttcgctgcgcctgcgtgtgaaggcggggaagtaat

SEQ ID NO: 18511 - DNA, 60 bp, Artificial Sequence
  Description of Artificial Sequence: Synthetic probe
tgcagaaaaggttcactacgctgggttcgctgcgcctgcgtgtgaaggcggggaagtaat

SEQ ID NO: 18512 - DNA, 60 bp, Artificial Sequence
  Description of Artificial Sequence: Synthetic probe
tgcagaaaaggttcacttcgctgggttcgctgcgcctgcgtgtgaaggcggggaagtaat

SEQ ID NO: 18513 - DNA, 60 bp, Artificial Sequence
  Description of Artificial Sequence: Synthetic probe
ggagtctaaggccagaatatggacagcacgagcgacagttagagaacaataaatacgtct

SEQ ID NO: 18514 - DNA, 60 bp, Artificial Sequence
  Description of Artificial Sequence: Synthetic probe
ggcgcgcgatcttaggtgcgcttaaatttggggttaaggttctcggtgacaaaattgatg

SEQ ID NO: 18515 - DNA, 60 bp, Artificial Sequence
  Description of Artificial Sequence: Synthetic probe
acgctcagcgaagcgtatcgtgagtttttaaatctgtctattggtagcgcatatacatcc

SEQ ID NO: 18516 - DNA, 60 bp, Artificial Sequence
  Description of Artificial Sequence: Synthetic probe
cgcaaacgagtcattcttcttgggatttgatctgggcatcgacgtcgtacactttgagga

SEQ ID NO: 18517 - DNA, 60 bp, Artificial Sequence
  Description of Artificial Sequence: Synthetic probe
tgtctcactttcacgcaaacgagtcattcttcttgggatttgatctgggcatcgacgtcg

SEQ ID NO: 18518 - DNA, 60 bp, Artificial Sequence
  Description of Artificial Sequence: Synthetic probe
ccgtgggattcagacgatgttttcttctttcactgtgtgtctcactttcacgcaaacgag

SEQ ID NO: 18519 - DNA, 60 bp, Artificial Sequence
  Description of Artificial Sequence: Synthetic probe
tatatatagtgcaccgtgggattcagacgatgttttcttctttcactgtgtgtctcactt

SEQ ID NO: 18520 - DNA, 60 bp, Artificial Sequence
  Description of Artificial Sequence: Synthetic probe
cgtacaagctcaagaaagtaataaacgcgttgagcgggattgatctatcgcacttgcgca

SEQ ID NO: 18521 - DNA, 60 bp, Artificial Sequence
  Description of Artificial Sequence: Synthetic probe
gatccaagagatagcgggaatgactgcagatgtacttgaagctgcatcagaggaggtacc

SEQ ID NO: 18522 - DNA, 55 bp, Artificial Sequence
  Description of Artificial Sequence: Synthetic probe
ggagtatagacaaaagattgacgcattaaaggcggctattgaggtcgagagagat

SEQ ID NO: 18523 - DNA, 60 bp, Artificial Sequence
  Description of Artificial Sequence: Synthetic probe
aaggtagcgtacattcaattatgacaggagaatcatacggtgaatcagtcaagcaggcgg

SEQ ID NO: 18524 - DNA, 60 bp, Artificial Sequence
  Description of Artificial Sequence: Synthetic probe
tcgatgggttagttcaaggtagcgtacattcaattatgacaggagaatcatacggtgaat

SEQ ID NO: 18525 - DNA, 60 bp, Artificial Sequence
  Description of Artificial Sequence: Synthetic probe
acatcgaatacagcgaagaaaatttacagcacaatcgggaaggcggcggagcggttcgcg

SEQ ID NO: 18526 - DNA, 60 bp, Artificial Sequence
  Description of Artificial Sequence: Synthetic probe
gtggggaacgcgttgacatcgaatacagcgaagaaaatttacagcacaatcgggaaggcg

SEQ ID NO: 18527 - DNA, 60 bp, Artificial Sequence
  Description of Artificial Sequence: Synthetic probe
acctcaatggtttaagagtttgaatccaatgttaggcgtggtgaatttgggagctacctt

SEQ ID NO: 18528 - DNA, 60 bp, Artificial Sequence
  Description of Artificial Sequence: Synthetic probe
cctaaggtcagtaggtagagtggcgccccaaggtccgtatcgtgtagagtggttgatctc

SEQ ID NO: 18529 - DNA, 60 bp, Artificial Sequence
  Description of Artificial Sequence: Synthetic probe
acctaaggtcagtaggtagagtggcgccccaaggtccgtatcgtgtagagtggttgatct

SEQ ID NO: 18530 - DNA, 60 bp, Artificial Sequence
  Description of Artificial Sequence: Synthetic probe
ctacgtggacctatacactttcaaagacgagcgatcctgggagcgttaaagttcggctgt

SEQ ID NO: 18531 - DNA, 60 bp, Artificial Sequence
  Description of Artificial Sequence: Synthetic probe
ggtgcatccgatttacttgggttctttacactatgatatttcttttccggatttacgggg

SEQ ID NO: 18532 - DNA, 60 bp, Artificial Sequence
  Description of Artificial Sequence: Synthetic probe
aaagtcatacatccgaaggttatgatgagattcaaaattccaagagctcaacagcctcaa

SEQ ID NO: 18533 - DNA, 60 bp, Artificial Sequence
  Description of Artificial Sequence: Synthetic probe
cgggaaggcggccgaaagatttgcagaaagtgaaatcgggtcagctgcaatcgatgggct

SEQ ID NO: 18534 - DNA, 60 bp, Artificial Sequence
  Description of Artificial Sequence: Synthetic probe
agcacgatcgggaaggcggccgaaagatttgcagaaagtgaaatcgggtcagctgcaatc

SEQ ID NO: 18535 - DNA, 60 bp, Artificial Sequence
  Description of Artificial Sequence: Synthetic probe
tgctgcaggcaaagattcggaggcagcgtatttccgcagtatgttacctttccacatggt

SEQ ID NO: 18536 - DNA, 60 bp, Artificial Sequence
  Description of Artificial Sequence: Synthetic probe
ataggggcgcgagagagcgcggttatgttagtttcaaacagtataaaagatgtggcgcga

SEQ ID NO: 18537 - DNA, 60 bp, Artificial Sequence
  Description of Artificial Sequence: Synthetic probe
cgcaatcggagagcggccagaaggaagagggcggcaaagagactaaagatgcagatgtgg

SEQ ID NO: 18538 - DNA, 60 bp, Artificial Sequence
  Description of Artificial Sequence: Synthetic probe
gcagagtatttcaagtgatgttcctgccgattcagttgatcaatttcttaaggatggatg

SEQ ID NO: 18539 - DNA, 60 bp, Artificial Sequence
  Description of Artificial Sequence: Synthetic probe
acttcgctgggttcgcagcacctgcgtgtgaaagtggggaagtaatcaacttagctgcgc

SEQ ID NO: 18540 - DNA, 60 bp, Artificial Sequence
  Description of Artificial Sequence: Synthetic probe
gctctgctcaggctgttctgtttcgtgtgttatggatatgcgccacgtgcagatgggacg

SEQ ID NO: 18541 - DNA, 60 bp, Artificial Sequence
  Description of Artificial Sequence: Synthetic probe
caaactgttacactggagcagaggcattgattacaaccgcgattcatatccatcgctgga

SEQ ID NO: 18542 - DNA, 60 bp, Artificial Sequence
  Description of Artificial Sequence: Synthetic probe
caaatcccaacctgtggcgtgattgatgtacgtgcgtcagaactgactgggtgttcgcca

SEQ ID NO: 18543 - DNA, 60 bp, Artificial Sequence
  Description of Artificial Sequence: Synthetic probe
ggctactacctatgattattgtgcgtgagggattggatcatcaggatcggtgggagtggc

SEQ ID NO: 18544 - DNA, 60 bp, Artificial Sequence
  Description of Artificial Sequence: Synthetic probe
gacaagttaacacatgtccttatactggatacaaaggtagagtgcttcaggtaatgtttt

SEQ ID NO: 18545 - DNA, 60 bp, Artificial Sequence
  Description of Artificial Sequence: Synthetic probe
caactgcttgaggattaccgcaaaaatgggatgatggatgaggccgtgaaacagtctgcg

SEQ ID NO: 18546 - DNA, 60 bp, Artificial Sequence
  Description of Artificial Sequence: Synthetic probe
gaggaggatgttgaagggaagatgaagcggtgcggagtgcaactgcttgaggattaccgc

SEQ ID NO: 18547 - DNA, 60 bp, Artificial Sequence
  Description of Artificial Sequence: Synthetic probe
gggagacggtttggctccaatgtttcaaaagtttctctcaaccgtacgaggaggatgttg

SEQ ID NO: 18548 - DNA, 60 bp, Artificial Sequence
  Description of Artificial Sequence: Synthetic probe
caccacaatggacttgcagtcacttaaagaggaattgtttattcaatgggatgtgtgcca

SEQ ID NO: 18549 - DNA, 60 bp, Artificial Sequence
  Description of Artificial Sequence: Synthetic probe
gcttatacgagcgcaggaggggatgttaagattgaattcctgcatttaatcgatcacctc

SEQ ID NO: 18550 - DNA, 60 bp, Artificial Sequence
  Description of Artificial Sequence: Synthetic probe
tgtaagccgtgcgactgcatattttacatcaccgacgggagatccgaactggaaagaggt

SEQ ID NO: 18551 - DNA, 60 bp, Artificial Sequence
  Description of Artificial Sequence: Synthetic probe
tgagccaaaagaaattgttaagtatgatcggaggcgtggagaggaaagccagactagttg

SEQ ID NO: 18552 - DNA, 60 bp, Artificial Sequence
  Description of Artificial Sequence: Synthetic probe
caaccacaggagaaaactacgaacggtggaattgtgatcgaaggggtgatgagccaaaag

SEQ ID NO: 18553 - DNA, 60 bp, Artificial Sequence
  Description of Artificial Sequence: Synthetic probe
gcaaccacaggagaaaactacgaacggtggaattgtgatcgaaggggtgatgagccaaaa

SEQ ID NO: 18554 - DNA, 60 bp, Artificial Sequence
  Description of Artificial Sequence: Synthetic probe
aaggatggaagtttgaagcaggaagctcaaccgcagcaaccacaggagaaaactacgaac

SEQ ID NO: 18555 - DNA, 60 bp, Artificial Sequence
  Description of Artificial Sequence: Synthetic probe
tctaagggaaagaaaaaggatggaagtttgaagcaggaagctcaaccgcagcaaccacag

SEQ ID NO: 18556 - DNA, 60 bp, Artificial Sequence
  Description of Artificial Sequence: Synthetic probe
ccgggagggtattgcggaacaaacggagcggttgagggatttgaagcgtcgagaaagagg

SEQ ID NO: 18557 - DNA, 60 bp, Artificial Sequence
  Description of Artificial Sequence: Synthetic probe
ctgacccgggagggtattgcggaacaaacggagcggttgagggatttgaagcgtcgagaa

SEQ ID NO: 18558 - DNA, 60 bp, Artificial Sequence
  Description of Artificial Sequence: Synthetic probe
ttgaagtagaacggagtctgcagaaggaattgggactgacccgggagggtattgcggaac

SEQ ID NO: 18559 - DNA, 60 bp, Artificial Sequence
  Description of Artificial Sequence: Synthetic probe
gcgatcgagtctaaatacggtacgaaagtggaggtgtacatggacgaaccaacggcgcaa

SEQ ID NO: 18560 - DNA, 60 bp, Artificial Sequence
  Description of Artificial Sequence: Synthetic probe
ggagcagatgagagaagatgggtagtactaactgaggaaatcgcacgagcgatcgagtct

SEQ ID NO: 18561 - DNA, 60 bp, Artificial Sequence
  Description of Artificial Sequence: Synthetic probe
gatggagcagatgagagaagatgggtagtactaactgaggaaatcgcacgagcgatcgag

SEQ ID NO: 18562 - DNA, 60 bp, Artificial Sequence
  Description of Artificial Sequence: Synthetic probe
attagaggaagcgcaaacgagaatgcagacggaggagatggagcgactacaagacgagat

SEQ ID NO: 18563 - DNA, 60 bp, Artificial Sequence
  Description of Artificial Sequence: Synthetic probe
ggacgcgtacatactgcagtgggatttggatcaggcgcagagggaattagaggaagcgca

SEQ ID NO: 18564 - DNA, 51 bp, Artificial Sequence
  Description of Artificial Sequence: Synthetic probe
agaaaatggtgaggagacagaatcgcagagcggcaaggagaaaaagagcgg

SEQ ID NO: 18565 - DNA, 60 bp, Artificial Sequence
  Description of Artificial Sequence: Synthetic probe
tccgaggaactaaaacagaggcaaattcagattaatctaatagattgggcggaagacgga

SEQ ID NO: 18566 - DNA, 60 bp, Artificial Sequence
  Description of Artificial Sequence: Synthetic probe
cgatggctcaagggaattcacgacaaacgctggctggcgtgactgttagggtcggaggtg

SEQ ID NO: 18567 - DNA, 60 bp, Artificial Sequence
  Description of Artificial Sequence: Synthetic probe
cgcgatggctcaagggaattcacgacaaacgctggctggcgtgactgttagggtcggagg

SEQ ID NO: 18568 - DNA, 60 bp, Artificial Sequence
  Description of Artificial Sequence: Synthetic probe
tgcgtgggccgatacactttcagcgcagggcaatcttaggtgcgcttaaacatggcatta

SEQ ID NO: 18569 - DNA, 60 bp, Artificial Sequence
  Description of Artificial Sequence: Synthetic probe
gctttaggcgccgcgcaaacggttgttggacgcacgttccaagaggcgtaccgagagttt

SEQ ID NO: 18570 - DNA, 60 bp, Artificial Sequence
  Description of Artificial Sequence: Synthetic probe
actgcgcattggcacgctttaggcgccgcgcaaacggttgttggacgcacgttccaagag

SEQ ID NO: 18571 - DNA, 60 bp, Artificial Sequence
  Description of Artificial Sequence: Synthetic probe
atttctggaatcgaggagtctgtgatacatcctaaagtgatgatgagattcaagatcccc

SEQ ID NO: 18572 - DNA, 60 bp, Artificial Sequence
  Description of Artificial Sequence: Synthetic probe
cgctacaacattagagtatagagataggccaattccggatgactcactagcagtcagcgt

SEQ ID NO: 18573 - DNA, 60 bp, Artificial Sequence
  Description of Artificial Sequence: Synthetic probe
cggtattgacttgactcatttacgtacgccaaagatagaacccagcttaatcgctacaac

SEQ ID NO: 18574 - DNA, 60 bp, Artificial Sequence
  Description of Artificial Sequence: Synthetic probe
cgagatgcccgatttaccaggtgtgatgaggtcaaactacgatgttcgtgaactgcggca

SEQ ID NO: 18575 - DNA, 60 bp, Artificial Sequence
  Description of Artificial Sequence: Synthetic probe
cggaacgagatgcccgatttaccaggtgtgatgaggtcaaactacgatgttcgtgaactg

SEQ ID NO: 18576 - DNA, 60 bp, Artificial Sequence
  Description of Artificial Sequence: Synthetic probe
gcggaatgactttgatcggaacgagatgcccgatttaccaggtgtgatgaggtcaaatta

SEQ ID NO: 18577 - DNA, 60 bp, Artificial Sequence
  Description of Artificial Sequence: Synthetic probe
gcccaatgtttattccactggtatagcgagacataaaatatacgagaaaacggtgttaag

SEQ ID NO: 18578 - DNA, 60 bp, Artificial Sequence
  Description of Artificial Sequence: Synthetic probe
cgatcagaactggtaattagcagataccgctattcacgtcgacacatacgtggtgttgta

SEQ ID NO: 18579 - DNA, 60 bp, Artificial Sequence
  Description of Artificial Sequence: Synthetic probe
cgtaccggttatcactacaaagttggacacacttagagtgcatttagcagcattatgcgg

SEQ ID NO: 18580 - DNA, 60 bp, Artificial Sequence
  Description of Artificial Sequence: Synthetic probe
cgatttgttatcgctactataccgatacgacaatatcgcaaggtgaggtaaacgtaccgg

SEQ ID NO: 18581 - DNA, 60 bp, Artificial Sequence
  Description of Artificial Sequence: Synthetic probe
agtgcgagataatgctgcataccggcatagacagtggtcaattcccatgatactttatga

SEQ ID NO: 18582 - DNA, 60 bp, Artificial Sequence
  Description of Artificial Sequence: Synthetic probe
gcgactggggaacggcgacttgatgtgttaaaacgggagtttccaacgttctacgtatgg

SEQ ID NO: 18583 - DNA, 60 bp, Artificial Sequence
  Description of Artificial Sequence: Synthetic probe
tgagcggcgcgaccaattgcgtgaggttggagaggcgcgaatgatcatatatcaaatcca

SEQ ID NO: 18584 - DNA, 60 bp, Artificial Sequence
  Description of Artificial Sequence: Synthetic probe
catgaaggtaatgagtatcaaacatatcgccatccagctattgattactcaaagcttggt

SEQ ID NO: 18585 - DNA, 60 bp, Artificial Sequence
  Description of Artificial Sequence: Synthetic probe
ggatgcaatttgtcgaagatgtactaaacacccgacagcagaagtcattagctcttcaac

SEQ ID NO: 18586 - DNA, 60 bp, Artificial Sequence
  Description of Artificial Sequence: Synthetic probe
ggattaaagcgccaatatttaatgcacggctgcggataacgaatggagtgattgaaagtg

SEQ ID NO: 18587 - DNA, 60 bp, Artificial Sequence
  Description of Artificial Sequence: Synthetic probe
ggaagcttacattacgtcgacttcagatttaatcttgccggattattttgataagtggat

SEQ ID NO: 18588 - DNA, 60 bp, Artificial Sequence
  Description of Artificial Sequence: Synthetic probe
cactggtgttatgaagaagtagcgccaattgaaactacctatgataatggatatatatgt

SEQ ID NO: 18589 - DNA, 60 bp, Artificial Sequence
  Description of Artificial Sequence: Synthetic probe
catacgctgcgtaccgttttcaactggagtgtgcggggtacgtatggcgggacagagcga

SEQ ID NO: 18590 - DNA, 60 bp, Artificial Sequence
  Description of Artificial Sequence: Synthetic probe
tttgcgaggtgcgttggttgcagcagagtgtgtgatgggtgatgtatatcatacgctgcg

SEQ ID NO: 18591 - DNA, 58 bp, Artificial Sequence
  Description of Artificial Sequence: Synthetic probe
taactgatgaatccaagttctatgctttaatcatgatagcggcgtcggacacacagca

SEQ ID NO: 18592 - DNA, 60 bp, Artificial Sequence
  Description of Artificial Sequence: Synthetic probe
gaagagggtatttcacgacgctttcaaattgagttagatggcatgtttagtgcggcgcgt

SEQ ID NO: 18593 - DNA, 60 bp, Artificial Sequence
  Description of Artificial Sequence: Synthetic probe
ggacgtaagatgatggatacacatgaagaaccgaaggatgaagagggtatttcacgacgc

SEQ ID NO: 18594 - DNA, 60 bp, Artificial Sequence
  Description of Artificial Sequence: Synthetic probe
cgggttttctggcactgtaatattcgtgtcggagttatgtacagagttttcagcaatcgg

SEQ ID NO: 18595 - DNA, 60 bp, Artificial Sequence
  Description of Artificial Sequence: Synthetic probe
ggtgagatgggacgacttgcgaaaatcaaagacaagtgggtgtcaaacgggttttctggc

SEQ ID NO: 18596 - DNA, 60 bp, Artificial Sequence
  Description of Artificial Sequence: Synthetic probe
cctagtgcaagtggaggtaaaggggaagtgcgcagatgaaattgcgggtgagatgggacg

SEQ ID NO: 18597 - DNA, 60 bp, Artificial Sequence
  Description of Artificial Sequence: Synthetic probe
gaggagacgtacgacagagatatgacgcagcaggggtaagatggtccagactatcacgag

SEQ ID NO: 18598 - DNA, 58 bp, Artificial Sequence
  Description of Artificial Sequence: Synthetic probe
aaaacgaattttgagctgattgcgacggcggagagaggagacgtacgacagagatatg

SEQ ID NO: 18599 - DNA, 60 bp, Artificial Sequence
  Description of Artificial Sequence: Synthetic probe
gtgaggcgactaagtgtaatcatgcgaacatagagctaatgcggagcttaacgatggtgg

SEQ ID NO: 18600 - DNA, 60 bp, Artificial Sequence
  Description of Artificial Sequence: Synthetic probe
tcagatctaaaaatgtcgatacggtgtactacgattatcatccgcttgagagtgaggcga

SEQ ID NO: 18601 - DNA, 60 bp, Artificial Sequence
  Description of Artificial Sequence: Synthetic probe
ggatataacactgcacgcgtatgataagagacggtcgatgaaggatatatgtggattaga

SEQ ID NO: 18602 - DNA, 60 bp, Artificial Sequence
  Description of Artificial Sequence: Synthetic probe
gatcgtgaattccatgacctgacaaagattccccaatctaatatgatagatatttcacaa

SEQ ID NO: 18603 - DNA, 60 bp, Artificial Sequence
  Description of Artificial Sequence: Synthetic probe
ggatgagctagttataccaatattctcagcggatgaaatgccttatgcactaataagtca

SEQ ID NO: 18604 - DNA, 60 bp, Artificial Sequence
  Description of Artificial Sequence: Synthetic probe
aaactttttcatgatgatgggaatatatttttaatggatttcgagaaagacgcgaaattg

SEQ ID NO: 18605 - DNA, 58 bp, Artificial Sequence
  Description of Artificial Sequence: Synthetic probe
atatccgctgagagatgaagcgcctgatgacgggatgcactgtaagattgatatgaac

SEQ ID NO: 18606 - DNA, 60 bp, Artificial Sequence
  Description of Artificial Sequence: Synthetic probe
gttaactatggaatcgcaaacgacttgggatgagggatatccgctgagagatgaagcgcc

SEQ ID NO: 18607 - DNA, 60 bp, Artificial Sequence
  Description of Artificial Sequence: Synthetic probe
caatggactcgagagttaactatggaatcgcaaacgacttgggatgagggatatccgctg

SEQ ID NO: 18608 - DNA, 60 bp, Artificial Sequence
  Description of Artificial Sequence: Synthetic probe
ttgacacagagaacacaccagccgcgcgggtcatacaatggactcgagagttaactatgg

SEQ ID NO: 18609 - DNA, 60 bp, Artificial Sequence
  Description of Artificial Sequence: Synthetic probe
ctagaataaatctgtttgacacagagaacacaccagccgcgcgggtcatacaatggactc

SEQ ID NO: 18610 - DNA, 60 bp, Artificial Sequence
  Description of Artificial Sequence: Synthetic probe
gcggcggataaaacgctagagaataatgcgcatgtctttgctagaataaatctgtttgac

SEQ ID NO: 18611 - DNA, 60 bp, Artificial Sequence
  Description of Artificial Sequence: Synthetic probe
tgataaccatgcggcggataaaacgctagagaataatgcgcatgtctttgctagaataaa

SEQ ID NO: 18612 - DNA, 60 bp, Artificial Sequence
  Description of Artificial Sequence: Synthetic probe
caggtgacccgtataaaaccttgcgacggaagtttaattgcagtgataaccatgcggcgg

SEQ ID NO: 18613 - DNA, 60 bp, Artificial Sequence
  Description of Artificial Sequence: Synthetic probe
tgcgtttcaggtgacccgtataaaaccttgcgacggaagtttaattgcagtgataaccat

SEQ ID NO: 18614 - DNA, 60 bp, Artificial Sequence
  Description of Artificial Sequence: Synthetic probe
gaaaatacagagaaaaccaacatcatgcagaatgtgagcggtcgcacagatgaggagagg

SEQ ID NO: 18615 - DNA, 60 bp, Artificial Sequence
  Description of Artificial Sequence: Synthetic probe
atctttttctccgaaaatacagagaaaaccaacatcatgcagaatgtgagcggtcgcaca

SEQ ID NO: 18616 - DNA, 55 bp, Artificial Sequence
  Description of Artificial Sequence: Synthetic probe
gtataaaatggaatgcagaggaagaacccaaggacgaaggggccatgtcgctgag

SEQ ID NO: 18617 - DNA, 60 bp, Artificial Sequence
  Description of Artificial Sequence: Synthetic probe
gggaggtgagagctacagaattatgtacgctattatcaaagattggacgtataaaatgga

SEQ ID NO: 18618 - DNA, 60 bp, Artificial Sequence
  Description of Artificial Sequence: Synthetic probe
cggctaaaccaaatccgtgccatttggatacgtgataagtcttctagggaggtgagagct

SEQ ID NO: 18619 - DNA, 60 bp, Artificial Sequence
  Description of Artificial Sequence: Synthetic probe
atggaacggctaaaccaaatccgtgccatttggatacgtgataagtcttctagggaggtg

SEQ ID NO: 18620 - DNA, 60 bp, Artificial Sequence
  Description of Artificial Sequence: Synthetic probe
gaaccagggtattcgctttttaaaagcgggatgctacagattacggtaagtggtgaggtg

SEQ ID NO: 18621 - DNA, 60 bp, Artificial Sequence
  Description of Artificial Sequence: Synthetic probe
gcagacctaagattggtagtttgggaaggaacgcgagaatagatatgagcgaaccagggt

SEQ ID NO: 18622 - DNA, 60 bp, Artificial Sequence
  Description of Artificial Sequence: Synthetic probe
tctacgagtgcactcacagagggaaagaatcgatgaaccattcgaggcgggcagacctaa

SEQ ID NO: 18623 - DNA, 60 bp, Artificial Sequence
  Description of Artificial Sequence: Synthetic probe
atgctgtacaagagtgtgcttacgctttaaaagatacgtatgttctacgagtgcactcac

SEQ ID NO: 18624 - DNA, 60 bp, Artificial Sequence
  Description of Artificial Sequence: Synthetic probe
ttatataatgctgtacaagagtgtgcttacgctttaaaagatacgtatgttctacgagtg

SEQ ID NO: 18625 - DNA, 60 bp, Artificial Sequence
  Description of Artificial Sequence: Synthetic probe
gcaaccacacgagggtgcatatggttaatcacctaataaataacggattatataatgctg

SEQ ID NO: 18626 - DNA, 59 bp, Artificial Sequence
  Description of Artificial Sequence: Synthetic probe
ttcctcactgatgataaatggatggaatggatgttatcagacgctatggatgttcagcc

SEQ ID NO: 18627 - DNA, 60 bp, Artificial Sequence
  Description of Artificial Sequence: Synthetic probe
gtgcgcgccttacgaggaagagcgtgcgaaataacgatggcctggacttcctcactgatg

SEQ ID NO: 18628 - DNA, 60 bp, Artificial Sequence
  Description of Artificial Sequence: Synthetic probe
tgagtgcgcgccttacgaggaagagcgtgcgaaataacgatggcctggacttcctcactg

SEQ ID NO: 18629 - DNA, 55 bp, Artificial Sequence
  Description of Artificial Sequence: Synthetic probe
gatccgaaaaaattgaaaggagggaaagcgatagatgtgcctgatggtgaggtgc

SEQ ID NO: 18630 - DNA, 60 bp, Artificial Sequence
  Description of Artificial Sequence: Synthetic probe
cgactgtgtagagatgcgacctatctgtgcaataggtagcggcagcggaaacacacttac

SEQ ID NO: 18631 - DNA, 60 bp, Artificial Sequence
  Description of Artificial Sequence: Synthetic probe
gcaatcgctcaaaatgggcacgaagctggcagcgccgactgtgtagagatgcgacctatc

SEQ ID NO: 18632 - DNA, 60 bp, Artificial Sequence
  Description of Artificial Sequence: Synthetic probe
gagggtttctattacactaatatgctagaagctcctcctgaaattgaccgcgtcgttcaa

SEQ ID NO: 18633 - DNA, 60 bp, Artificial Sequence
  Description of Artificial Sequence: Synthetic probe
gcatagagatatgttcccagagcctcggcttgatgacgtcgaaagatttagacaggaggg

SEQ ID NO: 18634 - DNA, 60 bp, Artificial Sequence
  Description of Artificial Sequence: Synthetic probe
taccctcgttacaaccgtcgcttaagctggtattggaggaggaagcttgggctgcggcga

SEQ ID NO: 18635 - DNA, 60 bp, Artificial Sequence
  Description of Artificial Sequence: Synthetic probe
cgtttgagccaacgcatcgtaatgagatgttggaagttgccccattaattgaatctgttt

SEQ ID NO: 18636 - DNA, 60 bp, Artificial Sequence
  Description of Artificial Sequence: Synthetic probe
ggtgctggctctgcaactgcccgtgaatccacaagtagtttgggacgttcctcggagttc

SEQ ID NO: 18637 - DNA, 51 bp, Artificial Sequence
  Description of Artificial Sequence: Synthetic probe
atcccgacgagagatcatcgtgggatggaagttgcggaaccagaagtgttg

SEQ ID NO: 18638 - DNA, 60 bp, Artificial Sequence
  Description of Artificial Sequence: Synthetic probe
cgttggctgctgagcaggtctccaaaatagttaaaatgccaagcatatcttttaggcaca

SEQ ID NO: 18639 - DNA, 60 bp, Artificial Sequence
  Description of Artificial Sequence: Synthetic probe
cgacgccctatttagaaggagatgtgctatcgagtgattcaggtccgttgttatcagtgt

SEQ ID NO: 18640 - DNA, 55 bp, Artificial Sequence
  Description of Artificial Sequence: Synthetic probe
ttttgagaatggatgattttgcgaagcattttaacaggtacgcctcgatggcgat

SEQ ID NO: 18641 - DNA, 60 bp, Artificial Sequence
  Description of Artificial Sequence: Synthetic probe
gtttggtgaagtcgtcaggctaatccctatcgaagttggggcgtatgcaaatagatttgg

SEQ ID NO: 18642 - DNA, 60 bp, Artificial Sequence
  Description of Artificial Sequence: Synthetic probe
aactgatttgttttgtgttcgactatattttcgagaagcatgtacagctacgcaacgcca

SEQ ID NO: 18643 - DNA, 60 bp, Artificial Sequence
  Description of Artificial Sequence: Synthetic probe
tggctcaacaagatgatttccccgcgctaacagattatacgaaggagaagaacggttgcc

SEQ ID NO: 18644 - DNA, 60 bp, Artificial Sequence
  Description of Artificial Sequence: Synthetic probe
cgaatccttatccgtgtctacgcggtgcgctaattgctgctgagtgtgagcttggcgacg

SEQ ID NO: 18645 - DNA, 60 bp, Artificial Sequence
  Description of Artificial Sequence: Synthetic probe
gctagatataacactacacgcttatgacaagaggaaatccacgaaaagcgcgaaaggggt

SEQ ID NO: 18646 - DNA, 60 bp, Artificial Sequence
  Description of Artificial Sequence: Synthetic probe
cgacgtgtgattatggcagctttaaaatatggtgtaaaggtgatgtcgagggcggatgat

SEQ ID NO: 18647 - DNA, 60 bp, Artificial Sequence
  Description of Artificial Sequence: Synthetic probe
ggctgaagtggaacatatgcagacgtcaattttaccacgcatcaaaaaagcgattgaaga

SEQ ID NO: 18648 - DNA, 60 bp, Artificial Sequence
  Description of Artificial Sequence: Synthetic probe
atccaacctaaaacgttagaagccatattggatgcgccgggggggaatgtaacggacttg

SEQ ID NO: 18649 - DNA, 60 bp, Artificial Sequence
  Description of Artificial Sequence: Synthetic probe
ggcgctggggtggcgacaagtatcgcaacagcgcgagcgatagaaggtgcttataaattg

SEQ ID NO: 18650 - DNA, 60 bp, Artificial Sequence
  Description of Artificial Sequence: Synthetic probe
gaacgtgaaggtttacaggatgaagcaatacaggagattgcggggatgagcgcggaagta

SEQ ID NO: 18651 - DNA, 60 bp, Artificial Sequence
  Description of Artificial Sequence: Synthetic probe
agatccagatgctggaaaaagcgttgcgagcgtacgggaacgtagtgaaggtcgaaggag

SEQ ID NO: 18652 - DNA, 60 bp, Artificial Sequence
  Description of Artificial Sequence: Synthetic probe
catcgtctgaagaggttggaggatgagcagaagggagaaattatacgtacgaagcacaat

SEQ ID NO: 18653 - DNA, 60 bp, Artificial Sequence
  Description of Artificial Sequence: Synthetic probe
gtcgtatggggagagcgtaaaacaggcggtaattctaaatgtagtgggtggaggcgattc

SEQ ID NO: 18654 - DNA, 60 bp, Artificial Sequence
  Description of Artificial Sequence: Synthetic probe
cgattgggaaagcagctgaaaggttcgtagaaagtgatctcggcagcgcaactatagatg

SEQ ID NO: 18655 - DNA, 60 bp, Artificial Sequence
  Description of Artificial Sequence: Synthetic probe
gttaaaaagtccttggtatcctgcatcatgggaaaaatcattaagtccctcggaaagttc

SEQ ID NO: 18656 - DNA, 60 bp, Artificial Sequence
  Description of Artificial Sequence: Synthetic probe
cgaatcaaacatggcgaaattgcacaacgacggaatgatgacccaatggtgaaacgtaca

SEQ ID NO: 18657 - DNA, 60 bp, Artificial Sequence
  Description of Artificial Sequence: Synthetic probe
aacgaggggttcctgagcatttgctgcacggttatgagtttacgattgactccagtacga

SEQ ID NO: 18658 - DNA, 60 bp, Artificial Sequence
  Description of Artificial Sequence: Synthetic probe
gcgtggcgtttaagctaaacggtacatcagctgagatacctcaatggtttaaaagtttga

SEQ ID NO: 18659 - DNA, 60 bp, Artificial Sequence
  Description of Artificial Sequence: Synthetic probe
ggtcggcataacaatcgaaggagttatgagtcaaaagaagcttttaagcatgataggtgg

SEQ ID NO: 18660 - DNA, 60 bp, Artificial Sequence
  Description of Artificial Sequence: Synthetic probe
tcgagatcgagcggagcttacaaaaggagctgggaatcacccgagagggagtggcggaac

SEQ ID NO: 18661 - DNA, 60 bp, Artificial Sequence
  Description of Artificial Sequence: Synthetic probe
gaagaaccaaaactagaaggagagagtgaagaacaagacaaattaagcgatggtgagggg

SEQ ID NO: 18662 - DNA, 60 bp, Artificial Sequence
  Description of Artificial Sequence: Synthetic probe
cataggtcagctgcgatgctacttgcacccggtgacgtgattaaacgttcatccgagggg

SEQ ID NO: 18663 - DNA, 60 bp, Artificial Sequence
  Description of Artificial Sequence: Synthetic probe
tcggtgacaaaattgatgtgccactcttcctcagaaacgcgtgactgcggtgatcccggg

SEQ ID NO: 18664 - DNA, 60 bp, Artificial Sequence
  Description of Artificial Sequence: Synthetic probe
ggttaaggttctcggtgacaagattgatgtgccactcttcctcagaaacgcgtgactgcg

SEQ ID NO: 18665 - DNA, 60 bp, Artificial Sequence
  Description of Artificial Sequence: Synthetic probe
tgcacttaaatttggggttaaggttctcggtgacaagattgatgtgccactcttcctcag

SEQ ID NO: 18666 - DNA, 60 bp, Artificial Sequence
  Description of Artificial Sequence: Synthetic probe
ttttcaaaggcgcgcgatcttaggtgcgcttaaatttggggttaaggttctcggtgacaa

SEQ ID NO: 18667 - DNA, 60 bp, Artificial Sequence
  Description of Artificial Sequence: Synthetic probe
cgcggaagatgggcaaaatcataaagtcattgagccgctttggcaaaaaggtggggaacg

SEQ ID NO: 18668 - DNA, 60 bp, Artificial Sequence
  Description of Artificial Sequence: Synthetic probe
cgcggaagatgggcaaaatcataaagtcattgagccgctttggcaaaaaggtggggaatg

SEQ ID NO: 18669 - DNA, 60 bp, Artificial Sequence
  Description of Artificial Sequence: Synthetic probe
ccaccaaacgatcgagatagcatcttaaccttacttttactgtctactttagcggatgtg

SEQ ID NO: 18670 - DNA, 60 bp, Artificial Sequence
  Description of Artificial Sequence: Synthetic probe
atgttgccgccaattttcccgccaaacgatcgagatagcatcttaaccttacttctactg

SEQ ID NO: 18671 - DNA, 60 bp, Artificial Sequence
  Description of Artificial Sequence: Synthetic probe
taacattgcgtggagttacaatgagacccacatcattagcgcagaggaatgaaatgtttt

SEQ ID NO: 18672 - DNA, 60 bp, Artificial Sequence
  Description of Artificial Sequence: Synthetic probe
atcactgcatttcgacttacttattcccccaaccgggggccgatgcggatatgtatgaat

SEQ ID NO: 18673 - DNA, 56 bp, Artificial Sequence
  Description of Artificial Sequence: Synthetic probe
ggggaacaagtaggtcgaaatgcagtgatactcgtcttttgaattcggtatcctgt

SEQ ID NO: 18674 - DNA, 60 bp, Artificial Sequence
  Description of Artificial Sequence: Synthetic probe
cagtgcattgattaagcacaggataccgaattcaaaagacgagtatcactgcatttcgac

SEQ ID NO: 18675 - DNA, 58 bp, Artificial Sequence
  Description of Artificial Sequence: Synthetic probe
agaactacactgccgaatatgctgccacccatctttccaccaaacgatcgagatagta

SEQ ID NO: 18676 - DNA, 60 bp, Artificial Sequence
  Description of Artificial Sequence: Synthetic probe
acgaagaggatgtcgaggggaagatgaagcgatgcggggtgcaactgctcgaggattacc

SEQ ID NO: 18677 - DNA, 60 bp, Artificial Sequence
  Description of Artificial Sequence: Synthetic probe
ggcacgcattaggggcggctcaaatggctgtgggacgtacactagtcgaagcgtacaaag

SEQ ID NO: 18678 - DNA, 60 bp, Artificial Sequence
  Description of Artificial Sequence: Synthetic probe
cgcaacaaccacagattcatgtttatacggcaccgtgggattctgatgatgtgtttttct

SEQ ID NO: 18679 - DNA, 60 bp, Artificial Sequence
  Description of Artificial Sequence: Synthetic probe
aatcctggagtaccgtacgagggatattccggataatgcgctcgcggttagcgttctgtc

SEQ ID NO: 18680 - DNA, 60 bp, Artificial Sequence
  Description of Artificial Sequence: Synthetic probe
ggcgtctgaagaagtgcctttaattggagcaggtatggcgacagctgtcgcgactgggag

SEQ ID NO: 18681 - DNA, 60 bp, Artificial Sequence
  Description of Artificial Sequence: Synthetic probe
gaagtgctatagaaattgaaagagatggtatgcaggaagaagcgatacaggagatagcgg

SEQ ID NO: 18682 - DNA, 60 bp, Artificial Sequence
  Description of Artificial Sequence: Synthetic probe
gatgcgacggcttgcgattgctttacagaaagaaattggtgagagaacacacgcggaaac

SEQ ID NO: 18683 - DNA, 60 bp, Artificial Sequence
  Description of Artificial Sequence: Synthetic probe
gtccgggagagcagggtatacagactaagttgaaagaactagaagaggaacagaggaacg

SEQ ID NO: 18684 - DNA, 60 bp, Artificial Sequence
  Description of Artificial Sequence: Synthetic probe
cggttcagcggcgatcgatggattagtacagggcagcgtgcactcaatattgacaggtga

SEQ ID NO: 18685 - DNA, 60 bp, Artificial Sequence
  Description of Artificial Sequence: Synthetic probe
gcagatttgggaagaaagtgggtaatgcgctcacatcaaacacagctaaaaagatctata

SEQ ID NO: 18686 - DNA, 60 bp, Artificial Sequence
  Description of Artificial Sequence: Synthetic probe
gtatatgagtttcccaaaattaatcctgctgcgtttgagacggaaggtacgccttccgcg

SEQ ID NO: 18687 - DNA, 60 bp, Artificial Sequence
  Description of Artificial Sequence: Synthetic probe
gaggatagtgaagaagtatatgagtttcccaaaattaatcctgctgcgtttgagacggaa

SEQ ID NO: 18688 - DNA, 60 bp, Artificial Sequence
  Description of Artificial Sequence: Synthetic probe
gcgttctaatcctaaccatcatggagaaacagtattgggagctcgaggatagtgaagaag

SEQ ID NO: 18689 - DNA, 60 bp, Artificial Sequence
  Description of Artificial Sequence: Synthetic probe
aagttacagctctacatgtcccatcgtaactaactattttttgctggaaaaattgtgcgt

SEQ ID NO: 18690 - DNA, 60 bp, Artificial Sequence
  Description of Artificial Sequence: Synthetic probe
gcgcgagatgagttatatgcaccactgcttaaacggcgcaacgaagatttaagttacagc

SEQ ID NO: 18691 - DNA, 60 bp, Artificial Sequence
  Description of Artificial Sequence: Synthetic probe
agaaacagagtccttcaacgatacatcagatgttagcgcgagatgagttatatgcaccac

SEQ ID NO: 18692 - DNA, 60 bp, Artificial Sequence
  Description of Artificial Sequence: Synthetic probe
gaatgagtctagctaagaaacagagtccttcaacgatacatcagatgttagcgcgagatg

SEQ ID NO: 18693 - DNA, 60 bp, Artificial Sequence
  Description of Artificial Sequence: Synthetic probe
ggcttcacatgtcgcattacgtggatctgagaccatccttaaaaggaatgagtctagcta

SEQ ID NO: 18694 - DNA, 60 bp, Artificial Sequence
  Description of Artificial Sequence: Synthetic probe
acttaggcttcacatgtcgcattacgtggatctgagaccatccttaaaaggaatgagtct

SEQ ID NO: 18695 - DNA, 60 bp, Artificial Sequence
  Description of Artificial Sequence: Synthetic probe
actctaaagcctgtacgagcggattgcgtcgatcaacttaggcttcacatgtcgcattac

SEQ ID NO: 18696 - DNA, 60 bp, Artificial Sequence
  Description of Artificial Sequence: Synthetic probe
ccattcgttaaaagaactctaaagcctgtacgagcggattgcgtcgatcaacttaggctt

SEQ ID NO: 18697 - DNA, 60 bp, Artificial Sequence
  Description of Artificial Sequence: Synthetic probe
cgtactataataaatggacgtatgctccgatgtttaatgcgagagttaaaccttgtgacg

SEQ ID NO: 18698 - DNA, 60 bp, Artificial Sequence
  Description of Artificial Sequence: Synthetic probe
tgtattcccatcgtactataataaatggacgtatgctccgatgtttaatgcgagagttaa

SEQ ID NO: 18699 - DNA, 60 bp, Artificial Sequence
  Description of Artificial Sequence: Synthetic probe
gaccttgagaaggatgttaagttgggtagcggatcacaaattgtattcccatcgtactat

SEQ ID NO: 18700 - DNA, 60 bp, Artificial Sequence
  Description of Artificial Sequence: Synthetic probe
ttattgtatgaccttgagaaggatgttaagttgggtagcggatcacaaattgtattccca

SEQ ID NO: 18701 - DNA, 60 bp, Artificial Sequence
  Description of Artificial Sequence: Synthetic probe
actaagtttgatgaagttagatatagcgaaatgatacaagcgattattgatggtggatgg

SEQ ID NO: 18702 - DNA, 51 bp, Artificial Sequence
  Description of Artificial Sequence: Synthetic probe
cggaagtatacgaggtcagcgatcataaaggtaaccattgtgatttatttc

SEQ ID NO: 18703 - DNA, 60 bp, Artificial Sequence
  Description of Artificial Sequence: Synthetic probe
ggatgaaggaccgggagggaaggtgatacattgggaatatgagttaatctcggaagtata

SEQ ID NO: 18704 - DNA, 60 bp, Artificial Sequence
  Description of Artificial Sequence: Synthetic probe
aaatacatattagcgcgaactaacctattcgatttggatgaaggaccgggagggaaggtg

SEQ ID NO: 18705 - DNA, 60 bp, Artificial Sequence
  Description of Artificial Sequence: Synthetic probe
gatcgagagcgtgataaatacatattagcgcgaactaacctattcgatttggatgaagga

SEQ ID NO: 18706 - DNA, 60 bp, Artificial Sequence
  Description of Artificial Sequence: Synthetic probe
cagggatgaggttccagcccagatcatcgaagtggagcgcagtctccggaaagagttggg

SEQ ID NO: 18707 - DNA, 60 bp, Artificial Sequence
  Description of Artificial Sequence: Synthetic probe
tgatgtttacagggatgaggttccagcccagatcatcgaagtggagcgcagtctccggaa

SEQ ID NO: 18708 - DNA, 52 bp, Artificial Sequence
  Description of Artificial Sequence: Synthetic probe
cataaaatttatggaatgccggaaatgccgccattatacatggaatatgcgg

SEQ ID NO: 18709 - DNA, 54 bp, Artificial Sequence
  Description of Artificial Sequence: Synthetic probe
tgcataaaatttatggaatgccggaaatgccgccactatacattgaatatgcgg

SEQ ID NO: 18710 - DNA, 60 bp, Artificial Sequence
  Description of Artificial Sequence: Synthetic probe
aaatcctcgattgcataaaatttatggaatgccggaaatgccgccactatacattgaata

SEQ ID NO: 18711 - DNA, 60 bp, Artificial Sequence
  Description of Artificial Sequence: Synthetic probe
ccgagcgcgcatccataggtgacacttttaacggaaggacgatagaattgaaccgtggcc

SEQ ID NO: 18712 - DNA, 60 bp, Artificial Sequence
  Description of Artificial Sequence: Synthetic probe
accctgcgctaacggcagagatatttaatgtgtacagttttagagatcacacttggcatg

SEQ ID NO: 18713 - DNA, 60 bp, Artificial Sequence
  Description of Artificial Sequence: Synthetic probe
agacgcttaaccagtaccctgcgctaacggcagagatatttaatgtgtacagttttagag

SEQ ID NO: 18714 - DNA, 50 bp, Artificial Sequence
  Description of Artificial Sequence: Synthetic probe
tacgcggagttacgatgagaccaacttcactagctcaaagaaatgaaatg

SEQ ID NO: 18715 - DNA, 60 bp, Artificial Sequence
  Description of Artificial Sequence: Synthetic probe
aggaatagcaatcaatagatataatggattgactctacgcggagttacgatgagaccaac

SEQ ID NO: 18716 - DNA, 60 bp, Artificial Sequence
  Description of Artificial Sequence: Synthetic probe
gacgcgcagaaggagagtaccgaggatgagaaaacacccgaggagccaacgagtgtggga

SEQ ID NO: 18717 - DNA, 60 bp, Artificial Sequence
  Description of Artificial Sequence: Synthetic probe
gaatccaatgttgggtgtggtgaatttgggagctaccttcctgatgatggtttgtgcgaa

SEQ ID NO: 18718 - DNA, 60 bp, Artificial Sequence
  Description of Artificial Sequence: Synthetic probe
gtattcacgtacttaagcggacaggatgacttccctacattgactaattatttgaagagt

SEQ ID NO: 18719 - DNA, 60 bp, Artificial Sequence
  Description of Artificial Sequence: Synthetic probe
cgtattcacgtacttaagcggacaggatgacttccctacattgactaattatttgaagag

SEQ ID NO: 18720 - DNA, 60 bp, Artificial Sequence
  Description of Artificial Sequence: Synthetic probe
cttaacaggataagaacagaatggataaatgcgtcatatgatagaactcggattagggcg

SEQ ID NO: 18721 - DNA, 60 bp, Artificial Sequence
  Description of Artificial Sequence: Synthetic probe
ggggaaattacgcagcttaacaggataagaacagaatggataaatgcgtcatatgataga

SEQ ID NO: 18722 - DNA, 60 bp, Artificial Sequence
  Description of Artificial Sequence: Synthetic probe
ggtatagtggtgccgaggctattggatattaccctaaaggcttacgatgacagaaagtcg

SEQ ID NO: 18723 - DNA, 60 bp, Artificial Sequence
  Description of Artificial Sequence: Synthetic probe
cgaggaatgatggtatagtggtgccgaggctattggatattaccctaaaggcttacgatg

SEQ ID NO: 18724 - DNA, 60 bp, Artificial Sequence
  Description of Artificial Sequence: Synthetic probe
agcgaaaattccagaatcggacatggttgatgttcctaaactagacatcgttagcgcgct

SEQ ID NO: 18725 - DNA, 60 bp, Artificial Sequence
  Description of Artificial Sequence: Synthetic probe
tggttatcataatctagcgaaaattccagaatcggacatggttgatgttcctaaactaga

SEQ ID NO: 18726 - DNA, 60 bp, Artificial Sequence
  Description of Artificial Sequence: Synthetic probe
tacgagaacttttttggctatttcaccacaatggacttgcagtcatctaaaaaggaattg

SEQ ID NO: 18727 - DNA, 60 bp, Artificial Sequence
  Description of Artificial Sequence: Synthetic probe
ggtcaaatccgtatccatgcttgcgcggcacattgattgcggcggagacaaaattaggcg

SEQ ID NO: 18728 - DNA, 60 bp, Artificial Sequence
  Description of Artificial Sequence: Synthetic probe
tttacggcgggaggaagatttactaacctaactcaaaatatggctcgtcagttggacatt

SEQ ID NO: 18729 - DNA, 57 bp, Artificial Sequence
  Description of Artificial Sequence: Synthetic probe
ttttacggcgggaggaagatttactaacctaactcaaaatatggctcgtcagttgga

SEQ ID NO: 18730 - DNA, 60 bp, Artificial Sequence
  Description of Artificial Sequence: Synthetic probe
acacagaaggcggagaaagctgcattcgcatcgtacgcggaagcgtttcgtgatgatgtg

SEQ ID NO: 18731 - DNA, 60 bp, Artificial Sequence
  Description of Artificial Sequence: Synthetic probe
aatgaggatcatggacattacccaatcgctcaagatgggcaccaagctggctgcgccaac

SEQ ID NO: 18732 - DNA, 60 bp, Artificial Sequence
  Description of Artificial Sequence: Synthetic probe
cgctggatggttttgaaatgccattaacctgaggacagtaggtagagtggcgccccaagg

SEQ ID NO: 18733 - DNA, 60 bp, Artificial Sequence
  Description of Artificial Sequence: Synthetic probe
cgctggatggcttcgaaatgccattaacctgaggacagtaggtagagtggcgccccgagg

SEQ ID NO: 18734 - DNA, 55 bp, Artificial Sequence
  Description of Artificial Sequence: Synthetic probe
agagcgagggtgggagcagcaggcgttaaaattagatgagttggtcttatcggag

SEQ ID NO: 18735 - DNA, 60 bp, Artificial Sequence
  Description of Artificial Sequence: Synthetic probe
gatgatctatatagtacttttaaacgtaaggttatagagcgagggtgggagcagcaggcg

SEQ ID NO: 18736 - DNA, 60 bp, Artificial Sequence
  Description of Artificial Sequence: Synthetic probe
gtgatggcaattgatgatgatctatatagtacttttaaacgtaaggttatagagcgaggg

SEQ ID NO: 18737 - DNA, 60 bp, Artificial Sequence
  Description of Artificial Sequence: Synthetic probe
gcacggttttccgtgcccagaaagtggtgatacggacatcgtgatggcaattgatgatga

SEQ ID NO: 18738 - DNA, 60 bp, Artificial Sequence
  Description of Artificial Sequence: Synthetic probe
ttgattatgagcacggttttccgtgcccagaaagtggtgatacggacatcgtgatggcaa

SEQ ID NO: 18739 - DNA, 59 bp, Artificial Sequence
  Description of Artificial Sequence: Synthetic probe
ctgtttgactacgctggtacacctggtactgagataatacattggcgcatcactcacaa

SEQ ID NO: 18740 - DNA, 60 bp, Artificial Sequence
  Description of Artificial Sequence: Synthetic probe
gaaatcgatttacaagtggactttgcgttcgagttactcgtcgcagcgtgagatcgatag

SEQ ID NO: 18741 - DNA, 60 bp, Artificial Sequence
  Description of Artificial Sequence: Synthetic probe
gtttacaagagcttgaaatcgatttacaagtggactttgcgttcgagttactcgtcgcag

SEQ ID NO: 18742 - DNA, 60 bp, Artificial Sequence
  Description of Artificial Sequence: Synthetic probe
gctaccgatagttttaagtggcgtatatggtggaataacccgtacccgtgtttgcgtggc

SEQ ID NO: 18743 - DNA, 60 bp, Artificial Sequence
  Description of Artificial Sequence: Synthetic probe
gatgatagcggctaccgatagttttaagtggcgtatatggtggaataacccgtacccgtg

SEQ ID NO: 18744 - DNA, 60 bp, Artificial Sequence
  Description of Artificial Sequence: Synthetic probe
ggcggttggaagtggcaggactcaaagacaaaagttttatgctttattgatgatagcggc

SEQ ID NO: 18745 - DNA, 60 bp, Artificial Sequence
  Description of Artificial Sequence: Synthetic probe
caggcggttggaagtggcaggactcaaagacaaaagttttatgctttattgatgatagcg

SEQ ID NO: 18746 - DNA, 60 bp, Artificial Sequence
  Description of Artificial Sequence: Synthetic probe
tgtttcgcgctgagaatagtgaatatgtcaatatacaggcggttggaagtggcaggactc

SEQ ID NO: 18747 - DNA, 60 bp, Artificial Sequence
  Description of Artificial Sequence: Synthetic probe
agagtattagattgatgtttcgcgctgagaatagtgaatatgtcaatatacaggcggttg

SEQ ID NO: 18748 - DNA, 60 bp, Artificial Sequence
  Description of Artificial Sequence: Synthetic probe
gaggatgagtttcacagagttctcgtcagtcccgctagatggtttcgaattaccattaac

SEQ ID NO: 18749 - DNA, 60 bp, Artificial Sequence
  Description of Artificial Sequence: Synthetic probe
agacgatgtatttttctttcactgtgtgtcgcacttccatgcgaatgaatcattctttct

SEQ ID NO: 18750 - DNA, 60 bp, Artificial Sequence
  Description of Artificial Sequence: Synthetic probe
caggtagagcgattgagggtgcgtacaaacttaagaaagtgataaacgctttaagtggca

SEQ ID NO: 18751 - DNA, 60 bp, Artificial Sequence
  Description of Artificial Sequence: Synthetic probe
tattgcaacaggtagagcgattgagggtgcgtacaaacttaagaaagtgataaacgcttt

SEQ ID NO: 18752 - DNA, 60 bp, Artificial Sequence
  Description of Artificial Sequence: Synthetic probe
cgcgcgcgttacagcgggaagcgactgaacgaacagaaaacgaatcgaagatggtcaagg

SEQ ID NO: 18753 - DNA, 60 bp, Artificial Sequence
  Description of Artificial Sequence: Synthetic probe
cgttggcgcgcgcgttacagcgagaagcgactgaacgaacagaaaacgaatcgaagatgg

SEQ ID NO: 18754 - DNA, 60 bp, Artificial Sequence
  Description of Artificial Sequence: Synthetic probe
acgttagcgcgcgcgttacagcgggaagcgactgaacgaacagaaaacgaatcgaagatg

SEQ ID NO: 18755 - DNA, 60 bp, Artificial Sequence
  Description of Artificial Sequence: Synthetic probe
ttattcagttttgagacctgagttcgcaatccacggtgtaaatccaatgcctggcccgct

SEQ ID NO: 18756 - DNA, 60 bp, Artificial Sequence
  Description of Artificial Sequence: Synthetic probe
ggttgggcgacgattgatgtcgagtatagagaacccgcaccctacgtacatgctcagcgt

SEQ ID NO: 18757 - DNA, 60 bp, Artificial Sequence
  Description of Artificial Sequence: Synthetic probe
tgtcgaagggaagatgaagcggtgcggggtgcaactgctcgaggattaccgcaagagtgg

SEQ ID NO: 18758 - DNA, 60 bp, Artificial Sequence
  Description of Artificial Sequence: Synthetic probe
cgaagaggatgtcgaagggaagatgaagcggtgcggggtgcaactgctcgaggattaccg

SEQ ID NO: 18759 - DNA, 60 bp, Artificial Sequence
  Description of Artificial Sequence: Synthetic probe
acgggtgctacgcaaacacagaaagcagagaaggctgcattcgcatcgtacgcaaaagcg

SEQ ID NO: 18760 - DNA, 60 bp, Artificial Sequence
  Description of Artificial Sequence: Synthetic probe
ggaggcacatctcaggggttgtttcgatctgcgtgagtcagggtggacaactgagggtgc

SEQ ID NO: 18761 - DNA, 60 bp, Artificial Sequence
  Description of Artificial Sequence: Synthetic probe
cgctagcgcgggcactacaacgtgaagccactgaaagaactgagaccgaatccaagatgg

SEQ ID NO: 18762 - DNA, 51 bp, Artificial Sequence
  Description of Artificial Sequence: Synthetic probe
agactcctactgctgtctaacgggggagggtgcgcgatactacacacttac

SEQ ID NO: 18763 - DNA, 54 bp, Artificial Sequence
  Description of Artificial Sequence: Synthetic probe
aagagagcagcaaagagactaaagatgcagatgtggatagacgcatacatactg

SEQ ID NO: 18764 - DNA, 60 bp, Artificial Sequence
  Description of Artificial Sequence: Synthetic probe
aagagagcagcaaagagactaaagatgcagatgtggatagacgcatacatactgcagtgg

SEQ ID NO: 18765 - DNA, 60 bp, Artificial Sequence
  Description of Artificial Sequence: Synthetic probe
aaattgatgtcccactcttcctacgaaacgcgtgacagcggtgatcccgggacttccact

SEQ ID NO: 18766 - DNA, 60 bp, Artificial Sequence
  Description of Artificial Sequence: Synthetic probe
cactgcgtgtcgcatttccacgccaacgagtcattctttctagggttcgatttgggtatt

SEQ ID NO: 18767 - DNA, 60 bp, Artificial Sequence
  Description of Artificial Sequence: Synthetic probe
ttggaggcggcatcggaggaggtgcctttagttggttctggtatggctaccgcgattgcg

SEQ ID NO: 18768 - DNA, 60 bp, Artificial Sequence
  Description of Artificial Sequence: Synthetic probe
tcagggcagcgtacattccatcataactggcgagtcttatggggaatccgttaaacaggc

SEQ ID NO: 18769 - DNA, 60 bp, Artificial Sequence
  Description of Artificial Sequence: Synthetic probe
gtgtggtgaatttgggggctaccttcctgatgatggtttgcgcgaaaagcgagggaactt

SEQ ID NO: 18770 - DNA, 57 bp, Artificial Sequence
  Description of Artificial Sequence: Synthetic probe
tatgttgttgtcaactttagctgatgtatataccgtactacgaccggagttcgctat

SEQ ID NO: 18771 - DNA, 60 bp, Artificial Sequence
  Description of Artificial Sequence: Synthetic probe
tatgttgttgtcaactttagctgatgtatataccgtactacgaccggagttcgctataca

SEQ ID NO: 18772 - DNA, 60 bp, Artificial Sequence
  Description of Artificial Sequence: Synthetic probe
tttgttgttgtcaactttagcagatgtatataccgtactacgaccggagttcgctataca

SEQ ID NO: 18773 - DNA, 57 bp, Artificial Sequence
  Description of Artificial Sequence: Synthetic probe
tttgttgttgtcaactttagcagatgtatataccgtactacgaccggagttcgctat

SEQ ID NO: 18774 - DNA, 57 bp, Artificial Sequence
  Description of Artificial Sequence: Synthetic probe
tttgttgttgtcaactttagctgatgtatataccgtactacgaccggagttcgctat

SEQ ID NO: 18775 - DNA, 60 bp, Artificial Sequence
  Description of Artificial Sequence: Synthetic probe
tttgttgttgtcaactttagctgatgtatataccgtactacgaccggagttcgctataca

SEQ ID NO: 18776 - DNA, 60 bp, Artificial Sequence
  Description of Artificial Sequence: Synthetic probe
gcgaggcgaaagaggaggaagtggttcagagacaatactcaatgctatgcaaagcggtag

SEQ ID NO: 18777 - DNA, 60 bp, Artificial Sequence
  Description of Artificial Sequence: Synthetic probe
ggcgaggcgaaagaggaggaagtggttcagagacaatactcaatgctatgcaaagcggta

SEQ ID NO: 18778 - DNA, 60 bp, Artificial Sequence
  Description of Artificial Sequence: Synthetic probe
gcggattgcgtcgatcaacttaggcttcacatgtcgcattacgtggatctgagaccatcc

SEQ ID NO: 18779 - DNA, 60 bp, Artificial Sequence
  Description of Artificial Sequence: Synthetic probe
ggttcagcggcgattgatggattggtacaggggagcgtacattcaatcataacgggcgaa

SEQ ID NO: 18780 - DNA, 60 bp, Artificial Sequence
  Description of Artificial Sequence: Synthetic probe
tacgagaacttttttggctatatcgcctcaatggacttgcagtcacttaaaaaggaattg

SEQ ID NO: 18781 - DNA, 60 bp, Artificial Sequence
  Description of Artificial Sequence: Synthetic probe
ctgtcgacgctcgcggatgtttattcggtgttgagacctgagtttgcaatacacggtgta

SEQ ID NO: 18782 - DNA, 60 bp, Artificial Sequence
  Description of Artificial Sequence: Synthetic probe
agaacagcaatactaaatagaacgaccttaccgaatatgcttccgccgattttcccacca

SEQ ID NO: 18783 - DNA, 60 bp, Artificial Sequence
  Description of Artificial Sequence: Synthetic probe
tgacagtgagtgtgggaggtgtggatatgagggcaggacggataatcgcgtgggatggac

SEQ ID NO: 18784 - DNA, 60 bp, Artificial Sequence
  Description of Artificial Sequence: Synthetic probe
gctcaagtggtcacgcctgtggtttgcggcccggatatgatccaggtttcattgaacgca

SEQ ID NO: 18785 - DNA, 60 bp, Artificial Sequence
  Description of Artificial Sequence: Synthetic probe
cgactccagagataccatttacaactgaggcagcgaatgagattgcgcgtgtaactggag

SEQ ID NO: 18786 - DNA, 60 bp, Artificial Sequence
  Description of Artificial Sequence: Synthetic probe
catgatgttgtcagctgctggaattaatgttggaccaatatcgccagattatacccaaca

SEQ ID NO: 18787 - DNA, 60 bp, Artificial Sequence
  Description of Artificial Sequence: Synthetic probe
gatgcgggcatgtgccacgttacaggaagcaagaattgtattagaagcgaatgtaatgga

SEQ ID NO: 18788 - DNA, 56 bp, Artificial Sequence
  Description of Artificial Sequence: Synthetic probe
tcgagcgagtgagagttggacaaatcttagctgtattgaataggagatttgtcgca

SEQ ID NO: 18789 - DNA, 58 bp, Artificial Sequence
  Description of Artificial Sequence: Synthetic probe
ggccgcgtcgttcagtacacatatgaaattgcgcgacttcaggcaaatatgggacagt

SEQ ID NO: 18790 - DNA, 60 bp, Artificial Sequence
  Description of Artificial Sequence: Synthetic probe
ttgtggcattgactcacgagagttgatcaatccgaccacttatggaattggtatgaccta

SEQ ID NO: 18791 - DNA, 60 bp, Artificial Sequence
  Description of Artificial Sequence: Synthetic probe
cgatattgtggcattgactcacgagagttgatcaatccgaccacttatggaattggtatg

SEQ ID NO: 18792 - DNA, 54 bp, Artificial Sequence
  Description of Artificial Sequence: Synthetic probe
aaccttattatgaacatagcaacgtgtttacctacgggagaatacatagcacca

SEQ ID NO: 18793 - DNA, 60 bp, Artificial Sequence
  Description of Artificial Sequence: Synthetic probe
gctgtacagctacaagagctcaggaactcaattggatggttagaacgattaggtcatagg

SEQ ID NO: 18794 - DNA, 60 bp, Artificial Sequence
  Description of Artificial Sequence: Synthetic probe
ccaccgaggtatgctccgagtgcgccaatgccatcatctatgccgacggttgcccttgaa

SEQ ID NO: 18795 - DNA, 60 bp, Artificial Sequence
  Description of Artificial Sequence: Synthetic probe
tttgctgagagtgagatcggatcagccgcgatcgatgggctagttcaaggtagtgtgcac

SEQ ID NO: 18796 - DNA, 60 bp, Artificial Sequence
  Description of Artificial Sequence: Synthetic probe
atcgagagacggtttggctccaatgtttcaaaagcttttcccaaccgtacgaagaggaca

SEQ ID NO: 18797 - DNA, 60 bp, Artificial Sequence
  Description of Artificial Sequence: Synthetic probe
ggcgtacagagaatttcttaatttgtctattggaagcacgttcacatcactaatgcacgc

SEQ ID NO: 18798 - DNA, 60 bp, Artificial Sequence
  Description of Artificial Sequence: Synthetic probe
aggtatgacggcggatgttctggaggcggcatcggaagaagttcctctagtgggatcggg

SEQ ID NO: 18799 - DNA, 60 bp, Artificial Sequence
  Description of Artificial Sequence: Synthetic probe
gcgcgttacagcgagaagcgactgaacgaactgaaaacgaatcgaagatggttaaagaat

SEQ ID NO: 18800 - DNA, 60 bp, Artificial Sequence
  Description of Artificial Sequence: Synthetic probe
atacctgaccctcccgtgcctgacatctctttgtgtagattcattgggctgcgcgttgaa

SEQ ID NO: 18801 - DNA, 60 bp, Artificial Sequence
  Description of Artificial Sequence: Synthetic probe
gatgtatacgcatacggagatgtttcaaagtggacgatacgacagttacgaggtcatggg

SEQ ID NO: 18802 - DNA, 60 bp, Artificial Sequence
  Description of Artificial Sequence: Synthetic probe
ttaaagacgtatttattgttctctaactgttgctcgtgttgtccatactccggccttaga

SEQ ID NO: 18803 - DNA, 60 bp, Artificial Sequence
  Description of Artificial Sequence: Synthetic probe
taacgtatgaagcattgaaatctaacgcacaaagaattgtatacgatgacgaattgcaga

SEQ ID NO: 18804 - DNA, 60 bp, Artificial Sequence
  Description of Artificial Sequence: Synthetic probe
cgatgcattatgatataacgtatgaagcattgaaatctaacgcacaaagaattgtatacg

SEQ ID NO: 18805 - DNA, 60 bp, Artificial Sequence
  Description of Artificial Sequence: Synthetic probe
cgcgaatttcttaatctggcgattagcaatacgtatacatctccaatgcatgctagacgt

SEQ ID NO: 18806 - DNA, 60 bp, Artificial Sequence
  Description of Artificial Sequence: Synthetic probe
ctctgggcgccgcacaagaagtgaaaggacgtaccttgaacgaggcgtatcgcgaatttc

SEQ ID NO: 18807 - DNA, 60 bp, Artificial Sequence
  Description of Artificial Sequence: Synthetic probe
cgttcatttcgaggatcttgctgcccactggcacgctctgggcgccgcacaagaagtgaa

SEQ ID NO: 18808 - DNA, 60 bp, Artificial Sequence
  Description of Artificial Sequence: Synthetic probe
tttgggtattgatgtcgttcatttcgaggatcttgctgcccactggcacgctctgggcgc

SEQ ID NO: 18809 - DNA, 60 bp, Artificial Sequence
  Description of Artificial Sequence: Synthetic probe
gaaaatccatcctagagtaatgatgagatttaaggtaccgcggtcgcagcaaccgcagat

SEQ ID NO: 18810 - DNA, 60 bp, Artificial Sequence
  Description of Artificial Sequence: Synthetic probe
agatgacaagaaaatccatcctagagtaatgatgagatttaaggtaccgcggtcgcagca

SEQ ID NO: 18811 - DNA, 60 bp, Artificial Sequence
  Description of Artificial Sequence: Synthetic probe
aagataatggatgaggaaaaggaattggagggtatagatgacaagaaaatccatcctaga

SEQ ID NO: 18812 - DNA, 60 bp, Artificial Sequence
  Description of Artificial Sequence: Synthetic probe
ctaccaaaattcaaaaagataatggatgaggaaaaggaattggagggtatagatgacaag

SEQ ID NO: 18813 - DNA, 60 bp, Artificial Sequence
  Description of Artificial Sequence: Synthetic probe
gaacctacgatggtcgcgacgacgttagaacataggtttgatgaaataccggataaagag

SEQ ID NO: 18814 - DNA, 60 bp, Artificial Sequence
  Description of Artificial Sequence: Synthetic probe
gagtggaatcgatctgtcacatctgcgaacgccgaagatcgaacctacgatggtcgcgac

SEQ ID NO: 18815 - DNA, 60 bp, Artificial Sequence
  Description of Artificial Sequence: Synthetic probe
agtaataaacgccttgagtggaatcgatctgtcacatctgcgaacgccgaagatcgaacc

SEQ ID NO: 18816 - DNA, 60 bp, Artificial Sequence
  Description of Artificial Sequence: Synthetic probe
gcgattgcgactgggagagcaatcgaaggagcatataaactcaagaaagtaataaacgcc

SEQ ID NO: 18817 - DNA, 60 bp, Artificial Sequence
  Description of Artificial Sequence: Synthetic probe
ggcatcggaggaggtgcctttagttggttctggtatggctaccgcgattgcgactgggag

SEQ ID NO: 18818 - DNA, 60 bp, Artificial Sequence
  Description of Artificial Sequence: Synthetic probe
tattggaggcggcatcggaggaggtgcctttagttggttctggtatggctaccgcgattg

SEQ ID NO: 18819 - DNA, 60 bp, Artificial Sequence
  Description of Artificial Sequence: Synthetic probe
cggagtcaacgatggtgaaggagtacagacaaaagattgatgccttgaaggcggctatcg

SEQ ID NO: 18820 - DNA, 60 bp, Artificial Sequence
  Description of Artificial Sequence: Synthetic probe
gctgtgcaaagctgtggattcgtacgagaagctattagtagctgaaaacgagcagatgcg

SEQ ID NO: 18821 - DNA, 60 bp, Artificial Sequence
  Description of Artificial Sequence: Synthetic probe
caaggtgctgtgcaaagctgtggattcgtacgagaagctattagtagctgaaaacgagca

SEQ ID NO: 18822 - DNA, 60 bp, Artificial Sequence
  Description of Artificial Sequence: Synthetic probe
cttatggggaatccgttaaacaggcggtgttgctcaatgttctgggtgccggtgatgaaa

SEQ ID NO: 18823 - DNA, 60 bp, Artificial Sequence
  Description of Artificial Sequence: Synthetic probe
catagatggattagttcagggcagcgtacattccatcataactggcgagtcttatgggga

SEQ ID NO: 18824 - DNA, 51 bp, Artificial Sequence
  Description of Artificial Sequence: Synthetic probe
aaaaagatctacagcacaatagggaaagcagcggagaggttcgcagaaagc

SEQ ID NO: 18825 - DNA, 60 bp, Artificial Sequence
  Description of Artificial Sequence: Synthetic probe
tgagccgttttggcaaaaaagttggaggtgcgttaacatctaacacggcaaaaaagatct

SEQ ID NO: 18826 - DNA, 60 bp, Artificial Sequence
  Description of Artificial Sequence: Synthetic probe
gatccccatgatcgcggaggatgggcaaaatcatcaaatcactgagccgttttggcaaaa

SEQ ID NO: 18827 - DNA, 60 bp, Artificial Sequence
  Description of Artificial Sequence: Synthetic probe
gttaaaaagatccccatgatcgcggaggatgggcaaaatcatcaaatcactgagccgttt

SEQ ID NO: 18828 - DNA, 60 bp, Artificial Sequence
  Description of Artificial Sequence: Synthetic probe
cgagttgcaaatgcatatcttaagaggtccactgcattttcaaaggcgcgcgatcttagg

SEQ ID NO: 18829 - DNA, 58 bp, Artificial Sequence
  Description of Artificial Sequence: Synthetic probe
atcgacgtcgtacactttgaggatttggccgctcattggcatgcactgggcgcggcgc

SEQ ID NO: 18830 - DNA, 55 bp, Artificial Sequence
  Description of Artificial Sequence: Synthetic probe
tgatgacaagaagatccacccgagggtaatgatgagattcaaggtgcctcgctcc

SEQ ID NO: 18831 - DNA, 60 bp, Artificial Sequence
  Description of Artificial Sequence: Synthetic probe
aagtaataaacgcgttgagcgggattgatctatcgcacttgcgcacgccgaagattgagc

SEQ ID NO: 18832 - DNA, 60 bp, Artificial Sequence
  Description of Artificial Sequence: Synthetic probe
gggaatgactgcagatgtacttgaagctgcatcagaggaggtaccgttggtaggctccgg

SEQ ID NO: 18833 - DNA, 60 bp, Artificial Sequence
  Description of Artificial Sequence: Synthetic probe
cgggaaggcggcggagcggttcgcggaaagtgaaattggatcagcggcaatcgatgggtt

SEQ ID NO: 18834 - DNA, 60 bp, Artificial Sequence
  Description of Artificial Sequence: Synthetic probe
gatgtgcagccgctcaaggtcgatactgcgcacacgagaacgcgagtgagccatgcgtta

SEQ ID NO: 18835 - DNA, 60 bp, Artificial Sequence
  Description of Artificial Sequence: Synthetic probe
gatgttaggaagatctacttagcgctaatgtttcctggacagattatacttgatctaaaa

SEQ ID NO: 18836 - DNA, 60 bp, Artificial Sequence
  Description of Artificial Sequence: Synthetic probe
gcttgtatatgacgaagatttacaaatgcacatattaagggggcccttacactttcagcg

SEQ ID NO: 18837 - DNA, 60 bp, Artificial Sequence
  Description of Artificial Sequence: Synthetic probe
cattctttctgggcttcgatttgggaattgatgttgttcatttcgaggatctcgctgcgc

SEQ ID NO: 18838 - DNA, 60 bp, Artificial Sequence
  Description of Artificial Sequence: Synthetic probe
tagacgacaagaagatacatccgagggtgatgatgagatttaaggtacctagatcacagc

SEQ ID NO: 18839 - DNA, 59 bp, Artificial Sequence
  Description of Artificial Sequence: Synthetic probe
aaagaactagctgtgagcgtcttagcgaaaaacgatgcgatagtagcgaatactaagga

SEQ ID NO: 18840 - DNA, 60 bp, Artificial Sequence
  Description of Artificial Sequence: Synthetic probe
taaacgctttaagtggcattgacttatcgcatttacgtactccaaagattgagccaacca

SEQ ID NO: 18841 - DNA, 60 bp, Artificial Sequence
  Description of Artificial Sequence: Synthetic probe
cggcgaagttaagggagaagaagagcaagaggagcaatataaagtcttatgtaaggccgt

SEQ ID NO: 18842 - DNA, 60 bp, Artificial Sequence
  Description of Artificial Sequence: Synthetic probe
aatgtgcttggtgcaggagatgaaatcccggatccactcagtcctggagagcgtggtatc

SEQ ID NO: 18843 - DNA, 60 bp, Artificial Sequence
  Description of Artificial Sequence: Synthetic probe
cgcatcgtacgcagaagcgtttcgtgatgatgtgaggctaagacagatcaaacgtcatgt

SEQ ID NO: 18844 - DNA, 51 bp, Artificial Sequence
  Description of Artificial Sequence: Synthetic probe
caaaaggatctggagaacgcgcggacgagaatgttaacagaggagatggaa

SEQ ID NO: 18845 - DNA, 60 bp, Artificial Sequence
  Description of Artificial Sequence: Synthetic probe
cacaaaaagcagagaaggctgcattcgcatcgtacgcggaagcgtttcgtgatgatgtaa

SEQ ID NO: 18846 - DNA, 55 bp, Artificial Sequence
  Description of Artificial Sequence: Synthetic probe
gagattttgggaatcgcaattaatagatacaatgggttaacacttagatcagtca

SEQ ID NO: 18847 - DNA, 58 bp, Artificial Sequence
  Description of Artificial Sequence: Synthetic probe
gcgtcggaggtgttgatatgagggcaggacgcataatcgcgtgggatgggcaagccgc

SEQ ID NO: 18848 - DNA, 60 bp, Artificial Sequence
  Description of Artificial Sequence: Synthetic probe
ccgaatagaatgacagttagaaatctcgaaaaccaattcgtttgagagcacgcgccgcat

SEQ ID NO: 18849 - DNA, 59 bp, Artificial Sequence
  Description of Artificial Sequence: Synthetic probe
gacgccatatcattgtattgcacgcagatggttatgcttcgcgcggcactcgggttacc

SEQ ID NO: 18850 - DNA, 60 bp, Artificial Sequence
  Description of Artificial Sequence: Synthetic probe
tgcacaagtttcgaggcgtctgggaaaggaatccggagtaatatcgacatcctatgcgaa

SEQ ID NO: 18851 - DNA, 60 bp, Artificial Sequence
  Description of Artificial Sequence: Synthetic probe
agtttcttctcgaagatggctagaccaaccgtccaacccgctctaagcgatccgcaaata

SEQ ID NO: 18852 - DNA, 60 bp, Artificial Sequence
  Description of Artificial Sequence: Synthetic probe
atagcgacaggaagtttgattcgaacgatgaagatggattcacgctaatacagatccgga

SEQ ID NO: 18853 - DNA, 60 bp, Artificial Sequence
  Description of Artificial Sequence: Synthetic probe
gacgtgcaaggatacgtgcgctcgcaagtgcaaacgatgataacaaaagtaagtagagga

SEQ ID NO: 18854 - DNA, 60 bp, Artificial Sequence
  Description of Artificial Sequence: Synthetic probe
ttaacacggtggctaagtgtggacatgaagcttcgcctagtaaaacgatgatgacgccgt

SEQ ID NO: 18855 - DNA, 60 bp, Artificial Sequence
  Description of Artificial Sequence: Synthetic probe
gctctaattgatacgcacctttccggcgagaactcaacccttattgctaattcgatgcat

SEQ ID NO: 18856 - DNA, 60 bp, Artificial Sequence
  Description of Artificial Sequence: Synthetic probe
aggtagcttcaaggttcccaaaggagtacttccagtatcgagtattgatgtggcgaatcg

SEQ ID NO: 18857 - DNA, 60 bp, Artificial Sequence
  Description of Artificial Sequence: Synthetic probe
ctagggtcggcggaataactagtccggattacaagaagatcggaggaaaggtgattgtcg

SEQ ID NO: 18858 - DNA, 60 bp, Artificial Sequence
  Description of Artificial Sequence: Synthetic probe
gtacgtacgggacgcaaatgcacacacgcaggttgattagatcgaagacagtacatccaa

SEQ ID NO: 18859 - DNA, 60 bp, Artificial Sequence
  Description of Artificial Sequence: Synthetic probe
cgtacgagagatattccagataacgcgcttgcggttagcgttttgtcaaagaatcgcgcg

SEQ ID NO: 18860 - DNA, 60 bp, Artificial Sequence
  Description of Artificial Sequence: Synthetic probe
gctattgaaattgaaagagatggtatgcaggaagaggcgatacaggaaatagcgggaatg

SEQ ID NO: 18861 - DNA, 60 bp, Artificial Sequence
  Description of Artificial Sequence: Synthetic probe
ggcttgcgatcgctttacagaaagaaatcggtgaaagaacacacgcggaaacatccatgg

SEQ ID NO: 18862 - DNA, 60 bp, Artificial Sequence
  Description of Artificial Sequence: Synthetic probe
taatcaagatagagttgaagaactgaggttagtgcgtgtggatgataccatttctcaacc

SEQ ID NO: 18863 - DNA, 60 bp, Artificial Sequence
  Description of Artificial Sequence: Synthetic probe
ccaaggtatgctccgagtgcgccgatgccatcatcaatgccaacggttgcccttgaaata

SEQ ID NO: 18864 - DNA, 55 bp, Artificial Sequence
  Description of Artificial Sequence: Synthetic probe
ccaaggtatgctccgagtgcgccgatgccatcatcaatgccaacggttgcccttg

SEQ ID NO: 18865 - DNA, 53 bp, Artificial Sequence
  Description of Artificial Sequence: Synthetic probe
gctgcttaacgtttaacctcagtgacatgaggtgcacgaactaatcaacttac

SEQ ID NO: 18866 - DNA, 60 bp, Artificial Sequence
  Description of Artificial Sequence: Synthetic probe
ccgaggggttggtttggtatttaccgatcactcatccgacgaagtgtgtcgttgccattg

SEQ ID NO: 18867 - DNA, 60 bp, Artificial Sequence
  Description of Artificial Sequence: Synthetic probe
ctccgaggggttggtttggtatttaccgatcactcatccgacgaagtgtgtcgttgccat

SEQ ID NO: 18868 - DNA, 60 bp, Artificial Sequence
  Description of Artificial Sequence: Synthetic probe
gcggtgggtactccgaggggttggtttggtatttaccgatcactcatccgacgaagtgcg

SEQ ID NO: 18869 - DNA, 60 bp, Artificial Sequence
  Description of Artificial Sequence: Synthetic probe
cgtaaagttgagaagccatgtccaatggtaacgtgctcgtacgtattggagaaaacggct

SEQ ID NO: 18870 - DNA, 60 bp, Artificial Sequence
  Description of Artificial Sequence: Synthetic probe
gagggtatcgtaaagttgagaagccatgtccaatggtaacgtgttcgtacgtattagaga

SEQ ID NO: 18871 - DNA, 60 bp, Artificial Sequence
  Description of Artificial Sequence: Synthetic probe
ccttagctaaaacgaaggattacagtgatgtacttaatcgaagagggtatcgtaaagttg

SEQ ID NO: 18872 - DNA, 60 bp, Artificial Sequence
  Description of Artificial Sequence: Synthetic probe
ccttggctaaaacgaaggattacagtgatgtacttaatcgaagagggtatcgtaaagttg

SEQ ID NO: 18873 - DNA, 60 bp, Artificial Sequence
  Description of Artificial Sequence: Synthetic probe
cctatcataagaccttggctaaaacgaaggattacagtgatgtacttaatcgaagagggt

SEQ ID NO: 18874 - DNA, 60 bp, Artificial Sequence
  Description of Artificial Sequence: Synthetic probe
cttatcataaaaccttagctaaaacgaaggattacagtgatgtacttaatcgaagagggt

SEQ ID NO: 18875 - DNA, 54 bp, Artificial Sequence
  Description of Artificial Sequence: Synthetic probe
aaactcgacgagaagtttcgacttgatgatagtgaacgtggggtcatcttcaca

SEQ ID NO: 18876 - DNA, 60 bp, Artificial Sequence
  Description of Artificial Sequence: Synthetic probe
gatgatgcttataagaaaacgttgggcggattaaccaggttgcgtgtacaggggaaaata

SEQ ID NO: 18877 - DNA, 54 bp, Artificial Sequence
  Description of Artificial Sequence: Synthetic probe
aaaaccatcgagtggtactgggtgatgatgcttataagaaaacgttgggcggat

SEQ ID NO: 18878 - DNA, 60 bp, Artificial Sequence
  Description of Artificial Sequence: Synthetic probe
gcgtgtttccatgtggaataatctaacgaggcatgaaatgatgcactgtgcgcaagaaag

SEQ ID NO: 18879 - DNA, 60 bp, Artificial Sequence
  Description of Artificial Sequence: Synthetic probe
ctggatgatcaatgactcaatggatgtgcagccactgaaggttagcttaggtttgccacc

SEQ ID NO: 18880 - DNA, 60 bp, Artificial Sequence
  Description of Artificial Sequence: Synthetic probe
ggtactgaggaagagaagacgtctgaagaaccagcgagtgtcgggatcaccatagagggg

SEQ ID NO: 18881 - DNA, 60 bp, Artificial Sequence
  Description of Artificial Sequence: Synthetic probe
agagggtactgaggaagagaagacgtctgaagaaccagcgagtgtcgggatcaccataga

SEQ ID NO: 18882 - DNA, 53 bp, Artificial Sequence
  Description of Artificial Sequence: Synthetic probe
ggatagagagcgagagcgaaaaagagagtaaagcggaacccaaagagggagac

SEQ ID NO: 18883 - DNA, 50 bp, Artificial Sequence
  Description of Artificial Sequence: Synthetic probe
cgaagaaaagatacaagatacgtttgcagaggtttagaacgcacgtgcct

SEQ ID NO: 18884 - DNA, 60 bp, Artificial Sequence
  Description of Artificial Sequence: Synthetic probe
gacgcggtcaggttgataccggttgaagttggagcttacgcaaatagatttggtttaaaa

SEQ ID NO: 18885 - DNA, 60 bp, Artificial Sequence
  Description of Artificial Sequence: Synthetic probe
gttgatcgaaggcggatgggatcaggagcggttcaaactccacagtatcctcacggagcc

SEQ ID NO: 18886 - DNA, 60 bp, Artificial Sequence
  Description of Artificial Sequence: Synthetic probe
aacaggataagaacagaatggataggcgcgtcatatgatagaactcggattagggcgctg

SEQ ID NO: 18887 - DNA, 60 bp, Artificial Sequence
  Description of Artificial Sequence: Synthetic probe
catgacggatgctaaatggatgaagtgggcaatcgatgataggatggacattcagccgct

SEQ ID NO: 18888 - DNA, 60 bp, Artificial Sequence
  Description of Artificial Sequence: Synthetic probe
ggaggagttcgtcattcctgtgttttctgagagggagatcccttacgccctgatcaacca

SEQ ID NO: 18889 - DNA, 60 bp, Artificial Sequence
  Description of Artificial Sequence: Synthetic probe
catattgaagtataagtgcaaagtcgttttggttaggatgcctggacatgtgttcggaaa

SEQ ID NO: 18890 - DNA, 60 bp, Artificial Sequence
  Description of Artificial Sequence: Synthetic probe
taggactcgcagattcgatcgtttacacgctcccggttgcgcatccgaaaaagtgtattg

SEQ ID NO: 18891 - DNA, 60 bp, Artificial Sequence
  Description of Artificial Sequence: Synthetic probe
tcatgcgcatatttaaactacgagaagtaaaacgtatctgcgatttgagtgtgatcaact

SEQ ID NO: 18892 - DNA, 60 bp, Artificial Sequence
  Description of Artificial Sequence: Synthetic probe
aaaactgagtcctgaaatgcatgagggtttagaacaccaaatgtatgtacatccctccgc

SEQ ID NO: 18893 - DNA, 60 bp, Artificial Sequence
  Description of Artificial Sequence: Synthetic probe
cactcgggaggtattacgacatacgattacagctctttggtgataccttaagtcagaagc

SEQ ID NO: 18894 - DNA, 60 bp, Artificial Sequence
  Description of Artificial Sequence: Synthetic probe
aacgctagattgaggataactcatggggaaatcgggtcgtctaaaacgattgatccgtgg

SEQ ID NO: 18895 - DNA, 60 bp, Artificial Sequence
  Description of Artificial Sequence: Synthetic probe
cggagccaaatttactgacgattgattttgagaaagacgcgtacctaaactctcggtcgg

SEQ ID NO: 18896 - DNA, 60 bp, Artificial Sequence
  Description of Artificial Sequence: Synthetic probe
ccactggcaatatgagataaccgaaccagtcaagaccacttacgatgacggctacatatg

SEQ ID NO: 18897 - DNA, 60 bp, Artificial Sequence
  Description of Artificial Sequence: Synthetic probe
gcgaacaaatccatacccgtgtttgcgtggagcgctgatagcatccgaatgcgagttggg

SEQ ID NO: 18898 - DNA, 60 bp, Artificial Sequence
  Description of Artificial Sequence: Synthetic probe
cggattctgaacacgtgaacatattccgaacgagtggggctgccacaaacgagggtagat

SEQ ID NO: 18899 - DNA, 60 bp, Artificial Sequence
  Description of Artificial Sequence: Synthetic probe
gttcagagaaatgggtacaccttacgagacggaccaaaataggaaatagcggcttatcat

SEQ ID NO: 18900 - DNA, 60 bp, Artificial Sequence
  Description of Artificial Sequence: Synthetic probe
atctcgaattattgcgaagtttaacgacgattgaggcattccacatacttcaaggcgctg

SEQ ID NO: 18901 - DNA, 60 bp, Artificial Sequence
  Description of Artificial Sequence: Synthetic probe
gggagatcccttacgccctgatcaaccaatatcccttggcaattcagacggatgttagag

SEQ ID NO: 18902 - DNA, 60 bp, Artificial Sequence
  Description of Artificial Sequence: Synthetic probe
tactgtcgacgctcgcggatgtttgttcggtgttgaggcctgagtttgcaatacacggtg

SEQ ID NO: 18903 - DNA, 60 bp, Artificial Sequence
  Description of Artificial Sequence: Synthetic probe
cttaccaaatatgcttccaccgatttttccaccaaatgatagagatagcatcttaacaat

SEQ ID NO: 18904 - DNA, 54 bp, Artificial Sequence
  Description of Artificial Sequence: Synthetic probe
ggggtgtggatatgagggcaggacggataattgcgtgggatggacaagcggttc

SEQ ID NO: 18905 - DNA, 60 bp, Artificial Sequence
  Description of Artificial Sequence: Synthetic probe
ctggagtgacggtgagtgtagggggtgtggatatgagggcaggacggataattgcgtggg

SEQ ID NO: 18906 - DNA, 60 bp, Artificial Sequence
  Description of Artificial Sequence: Synthetic probe
cgccggattatacccagcatatggctaccatcggtgttctagcgactccagagataccat

SEQ ID NO: 18907 - DNA, 60 bp, Artificial Sequence
  Description of Artificial Sequence: Synthetic probe
accaatatcgccggattatacccagcatatggctaccatcggtgttctagcgactccaga

SEQ ID NO: 18908 - DNA, 60 bp, Artificial Sequence
  Description of Artificial Sequence: Synthetic probe
ggtataatggattgactttgcgtggagtcacgatgaggcccacctctctagctcaaagga

SEQ ID NO: 18909 - DNA, 60 bp, Artificial Sequence
  Description of Artificial Sequence: Synthetic probe
gaatagctatcaataggtataatggattgactttgcgtggagtcacgatgaggcccacct

SEQ ID NO: 18910 - DNA, 60 bp, Artificial Sequence
  Description of Artificial Sequence: Synthetic probe
ggacactatcgcagcaagagcactcactgtgatgcgggcatgtgccacgttacaagaggc

SEQ ID NO: 18911 - DNA, 60 bp, Artificial Sequence
  Description of Artificial Sequence: Synthetic probe
atggacactatcgcagcaagagcactcactgtgatgcgggcatgtgccacgttacaagag

SEQ ID NO: 18912 - DNA, 60 bp, Artificial Sequence
  Description of Artificial Sequence: Synthetic probe
ggtgaaaggatggatccagcagtaagaatggttgcaggcgttgtaggccatctgcttttc

SEQ ID NO: 18913 - DNA, 60 bp, Artificial Sequence
  Description of Artificial Sequence: Synthetic probe
gtgatagccgcttcaggtacaaacaatagtagggtttggtggtccaatccatacccctgc

SEQ ID NO: 18914 - DNA, 60 bp, Artificial Sequence
  Description of Artificial Sequence: Synthetic probe
gcagagaaacgaattggtaaggctgaagcatgggaaggagattacaaagaaatttggtga

SEQ ID NO: 18915 - DNA, 60 bp, Artificial Sequence
  Description of Artificial Sequence: Synthetic probe
ggtcgctggtgttgtaggtcatttactctttacggcaggtggaaggtttacaaatttgac

SEQ ID NO: 18916 - DNA, 60 bp, Artificial Sequence
  Description of Artificial Sequence: Synthetic probe
ggtcgctggtgttgtaggtcatttactctttacagcaggcggaagatttacaaatttgac

SEQ ID NO: 18917 - DNA, 60 bp, Artificial Sequence
  Description of Artificial Sequence: Synthetic probe
aaaaatgggaataagagagggagcctcgatcgactcgtggctggaattactgcgtcactt

SEQ ID NO: 18918 - DNA, 60 bp, Artificial Sequence
  Description of Artificial Sequence: Synthetic probe
gattctagactggtccgcgcagagcaaggaacaaaaattacgtgatctaaagaggtctgc

SEQ ID NO: 18919 - DNA, 60 bp, Artificial Sequence
  Description of Artificial Sequence: Synthetic probe
ctgttatgctcaacggatcctaccgtgatatcagaatcctggatggtaatggcgcaatcc

SEQ ID NO: 18920 - DNA, 60 bp, Artificial Sequence
  Description of Artificial Sequence: Synthetic probe
gagccacgagcggatctgttctatttaaccaaccgatgcaatatgggattggaacctagc

SEQ ID NO: 18921 - DNA, 60 bp, Artificial Sequence
  Description of Artificial Sequence: Synthetic probe
gtagatcgtcacatgcatccagacgcctccgtgatgaaagttgtttcgcgtgacgtgcgc

SEQ ID NO: 18922 - DNA, 60 bp, Artificial Sequence
  Description of Artificial Sequence: Synthetic probe
atcactgcatttcaacttacctatttccccagccgggggctgatgcggatatgtatgaat

SEQ ID NO: 18923 - DNA, 60 bp, Artificial Sequence
  Description of Artificial Sequence: Synthetic probe
cgcagaggataggttgggtgaagagatagcttacgaaatgggtggtgcattctctagtgc

SEQ ID NO: 18924 - DNA, 60 bp, Artificial Sequence
  Description of Artificial Sequence: Synthetic probe
gcagaagaggtgcactacgttgggtgtggtgacctgcgtaccttaatgcagtttaagaaa

SEQ ID NO: 18925 - DNA, 60 bp, Artificial Sequence
  Description of Artificial Sequence: Synthetic probe
agattggcagacgtagaatccgtatgcgtaagggatttggtgacgcgctaagaaattatg

SEQ ID NO: 18926 - DNA, 60 bp, Artificial Sequence
  Description of Artificial Sequence: Synthetic probe
gcgacagatgtgtacgcctacggggatgtttcaaagtggacgatacgacaattacgaggt

SEQ ID NO: 18927 - DNA, 60 bp, Artificial Sequence
  Description of Artificial Sequence: Synthetic probe
cgggatggcgtgattaatacatattcagaggggatcgccaaagccatgttgtgcgagaaa

SEQ ID NO: 18928 - DNA, 60 bp, Artificial Sequence
  Description of Artificial Sequence: Synthetic probe
caacgtcatatacgcggctcggttgtcgtctcggtcttgcgggatggcgtgattaataca

SEQ ID NO: 18929 - DNA, 60 bp, Artificial Sequence
  Description of Artificial Sequence: Synthetic probe
tgatgggagggggtcggcctcggactgcgtacggcgtgcgacacgtcgattgagatatat

SEQ ID NO: 18930 - DNA, 60 bp, Artificial Sequence
  Description of Artificial Sequence: Synthetic probe
cgatatgtggcgggttactcgattcgcttatctatctgatgccgattacccaccctgtca

SEQ ID NO: 18931 - DNA, 60 bp, Artificial Sequence
  Description of Artificial Sequence: Synthetic probe
ttgggcttacgtctttattctcttacttggttttccacgtagggaagtcaaaatatgggt

SEQ ID NO: 18932 - DNA, 60 bp, Artificial Sequence
  Description of Artificial Sequence: Synthetic probe
tgattttagtgtcacacaaactgagattcgtacccgttgagttgggggcttattacaaca

SEQ ID NO: 18933 - DNA, 60 bp, Artificial Sequence
  Description of Artificial Sequence: Synthetic probe
gcgtagacaggtgcgtactattgatgagtcacggtttattctctatcagataagggcgcg

SEQ ID NO: 18934 - DNA, 60 bp, Artificial Sequence
  Description of Artificial Sequence: Synthetic probe
gacaaggtagagtatttgagcccgtctctaaaccttgaatgggttgaaataacatcaagg

SEQ ID NO: 18935 - DNA, 60 bp, Artificial Sequence
  Description of Artificial Sequence: Synthetic probe
caaatttgcgaacccatgccctattacaactgctggccagtacgctctacaaaagacatc

SEQ ID NO: 18936 - DNA, 60 bp, Artificial Sequence
  Description of Artificial Sequence: Synthetic probe
gattacttatcattgatggtaggacgaggcgtcaccgacaaatttgcgaacccatgccct

SEQ ID NO: 18937 - DNA, 59 bp, Artificial Sequence
  Description of Artificial Sequence: Synthetic probe
ctatgagacccgatctggcgtgatgggcaggacgttaacaacaacgcagaagcagagtg

SEQ ID NO: 18938 - DNA, 60 bp, Artificial Sequence
  Description of Artificial Sequence: Synthetic probe
gctgcggacctattagactactctctgggttcctactatgagacccgatctggcgtgatg

SEQ ID NO: 18939 - DNA, 60 bp, Artificial Sequence
  Description of Artificial Sequence: Synthetic probe
gccacaatctagacccggcaatatcgcgtacgatgaaacccatgagggctaaagctgcgg

SEQ ID NO: 18940 - DNA, 60 bp, Artificial Sequence
  Description of Artificial Sequence: Synthetic probe
gcggcgccaatgtttagatgtgtgttgaaagtatgtgagacgtcaatctcagagcgccac

SEQ ID NO: 18941 - DNA, 60 bp, Artificial Sequence
  Description of Artificial Sequence: Synthetic probe
gttgaatgagagctcggagatgaacctgccttattattttaacaaggacatcgcggcgcc

SEQ ID NO: 18942 - DNA, 60 bp, Artificial Sequence
  Description of Artificial Sequence: Synthetic probe
gatgaatatgatttaatttgctcctttgatgaagctaaatacagcgaaatggtccaacgc

SEQ ID NO: 18943 - DNA, 60 bp, Artificial Sequence
  Description of Artificial Sequence: Synthetic probe
gccctcaggctgacgtcgcaagacagaatgagaactacgtgtacgcacgcgtcaatctat

SEQ ID NO: 18944 - DNA, 60 bp, Artificial Sequence
  Description of Artificial Sequence: Synthetic probe
ggcgctttaattgcgagcgaaactcaattcggcgatgtatataagatgctaagggtgcga

SEQ ID NO: 18945 - DNA, 60 bp, Artificial Sequence
  Description of Artificial Sequence: Synthetic probe
gatatggttagagaagagatggctgagctagtaaagataagggatagatggaaagttgcg

SEQ ID NO: 18946 - DNA, 60 bp, Artificial Sequence
  Description of Artificial Sequence: Synthetic probe
acagaccagtacaaccgcatgttgcagggatggtaccgggtgaaggtgaaaggtcaaatt

SEQ ID NO: 18947 - DNA, 57 bp, Artificial Sequence
  Description of Artificial Sequence: Synthetic probe
attttaaagccgactcaaaagatagaacctctcgctgaaaagaatgatctgggtgag

SEQ ID NO: 18948 - DNA, 60 bp, Artificial Sequence
  Description of Artificial Sequence: Synthetic probe
gggcagctcaggaggtagtgaacaaaggttgtaaccatgcgaaaagcgagatgtttcagc

SEQ ID NO: 18949 - DNA, 60 bp, Artificial Sequence
  Description of Artificial Sequence: Synthetic probe
tttaattgttctgctcgaatagatgctaaaaaagccgaggcgatttattatggttgggca

SEQ ID NO: 18950 - DNA, 60 bp, Artificial Sequence
  Description of Artificial Sequence: Synthetic probe
ggtggatctggctgatcttgaaggtaaagtgaggtatgatatgtttaattgttctgctcg

SEQ ID NO: 18951 - DNA, 60 bp, Artificial Sequence
  Description of Artificial Sequence: Synthetic probe
ggttgaagtgggctatcaaggattttatggatgtgcagccactgaaggtggatctggctg

SEQ ID NO: 18952 - DNA, 60 bp, Artificial Sequence
  Description of Artificial Sequence: Synthetic probe
ggggaggaatgatggttacgctttgccccgcattttagatgtatccatagcggcatatga

SEQ ID NO: 18953 - DNA, 60 bp, Artificial Sequence
  Description of Artificial Sequence: Synthetic probe
atgtgtgatgtaccgaatatagcgatgcaggatgctaattcagcaatattggggaggaat

SEQ ID NO: 18954 - DNA, 60 bp, Artificial Sequence
  Description of Artificial Sequence: Synthetic probe
tagatgaggaaggagacaaacatgatacgaccaagataccagaagcatatatgtgtgatg

SEQ ID NO: 18955 - DNA, 60 bp, Artificial Sequence
  Description of Artificial Sequence: Synthetic probe
ggcagagtgattccgtatgatttggtgcgttcgtatgacattgtagtggatttagatgtg

SEQ ID NO: 18956 - DNA, 60 bp, Artificial Sequence
  Description of Artificial Sequence: Synthetic probe
ggacctcgccagaatggatgaattcgcaattccaatcgtgcatggcagagtgattccgta

SEQ ID NO: 18957 - DNA, 60 bp, Artificial Sequence
  Description of Artificial Sequence: Synthetic probe
taaatccgatgccagggccgctcacacgtgctattgcacgcgccgcctatgtgtagtcca

SEQ ID NO: 18958 - DNA, 60 bp, Artificial Sequence
  Description of Artificial Sequence: Synthetic probe
cttaaggatggatgattttgcgaaacattttaacaggtatgcttcgatggcgatacagca

SEQ ID NO: 18959 - DNA, 60 bp, Artificial Sequence
  Description of Artificial Sequence: Synthetic probe
tgcgtttagttcaccaatacatgcaaagcgcatgattagatcacgaaccgtacaccccat

SEQ ID NO: 18960 - DNA, 60 bp, Artificial Sequence
  Description of Artificial Sequence: Synthetic probe
accgacaacccttgcaactacgttagatcggcggttcggcgagatatcggacaaagacct

SEQ ID NO: 18961 - DNA, 60 bp, Artificial Sequence
  Description of Artificial Sequence: Synthetic probe
gtactggagaggagttgccggaccctctaagtccaggagagcgtggattgcaagttaagc

SEQ ID NO: 18962 - DNA, 60 bp, Artificial Sequence
  Description of Artificial Sequence: Synthetic probe
ccgagagtgagatcggatcggcgacaatagacggattattacagggtagcgtacactcgc

SEQ ID NO: 18963 - DNA, 60 bp, Artificial Sequence
  Description of Artificial Sequence: Synthetic probe
tgcgctaacatcgaatacagcgaaaaagatttatgcgacaattggaagggcagcagaacg

SEQ ID NO: 18964 - DNA, 60 bp, Artificial Sequence
  Description of Artificial Sequence: Synthetic probe
cccttagcgaagatgggtaaagtcatacgatctctgagtagattcgggaagaaagtaggt

SEQ ID NO: 18965 - DNA, 60 bp, Artificial Sequence
  Description of Artificial Sequence: Synthetic probe
tgagggagtggctgagcagacggagagattgagagatctgcggcgaaaagagaagagtgg

SEQ ID NO: 18966 - DNA, 60 bp, Artificial Sequence
  Description of Artificial Sequence: Synthetic probe
gaaaatggggataagagagggagcctcgatcgattcgtggctggaattactgcgtcactt

SEQ ID NO: 18967 - DNA, 60 bp, Artificial Sequence
  Description of Artificial Sequence: Synthetic probe
cgtgttgcttttgtctctaaggacatgagcttgatcatattgcggtcggcgtttaggcgc

SEQ ID NO: 18968 - DNA, 60 bp, Artificial Sequence
  Description of Artificial Sequence: Synthetic probe
ctatgacattcgccccgctataatgggacaggcgctctcacgacaacaaggacaatctac

SEQ ID NO: 18969 - DNA, 60 bp, Artificial Sequence
  Description of Artificial Sequence: Synthetic probe
cgttagcgcgttactatgacattcgccccgctataatgggacaggcgctctcacgacaac

SEQ ID NO: 18970 - DNA, 60 bp, Artificial Sequence
  Description of Artificial Sequence: Synthetic probe
ttgcagaggctaacgttagcgcgttactatgacattcgccccgctataatgggacaggcg

SEQ ID NO: 18971 - DNA, 60 bp, Artificial Sequence
  Description of Artificial Sequence: Synthetic probe
gaccctattgtattgcagaggctaacgttagcgcgttactatgacattcgccccgctata

SEQ ID NO: 18972 - DNA, 60 bp, Artificial Sequence
  Description of Artificial Sequence: Synthetic probe
cctatcgcttttgaccctattgtattgcagaggctaacgttagcgcgttactatgacatt

SEQ ID NO: 18973 - DNA, 60 bp, Artificial Sequence
  Description of Artificial Sequence: Synthetic probe
cgtacattatctcctatcgcttttgaccctattgtattgcagaggctaacgttagcgcgt

SEQ ID NO: 18974 - DNA, 60 bp, Artificial Sequence
  Description of Artificial Sequence: Synthetic probe
atccaatggtgaaacgtacattatctcctatcgcttttgaccctattgtattgcagaggc

SEQ ID NO: 18975 - DNA, 60 bp, Artificial Sequence
  Description of Artificial Sequence: Synthetic probe
caacgacggaatgacgatccaatggtgaaacgtacattatctcctatcgcttttgaccct

SEQ ID NO: 18976 - DNA, 60 bp, Artificial Sequence
  Description of Artificial Sequence: Synthetic probe
aaatcgcacaacgacggaatgacgatccaatggtgaaacgtacattatctcctatcgctt

SEQ ID NO: 18977 - DNA, 60 bp, Artificial Sequence
  Description of Artificial Sequence: Synthetic probe
cgaatcaaacatagtgaaatcgcacaacgacggaatgacgatccaatggtgaaacgtaca

SEQ ID NO: 18978 - DNA, 60 bp, Artificial Sequence
  Description of Artificial Sequence: Synthetic probe
cgctaaattacgaatcaaacatagtgaaatcgcacaacgacggaatgacgatccaatggt

SEQ ID NO: 18979 - DNA, 60 bp, Artificial Sequence
  Description of Artificial Sequence: Synthetic probe
cgatgtttaacgctaaattacgaatcaaacatagtgaaatcgcacaacgacggaatgacg

SEQ ID NO: 18980 - DNA, 60 bp, Artificial Sequence
  Description of Artificial Sequence: Synthetic probe
gtggataatagcaccgatgtttaacgctaaattacgaatcaaacatagtgaaatcgcaca

SEQ ID NO: 18981 - DNA, 60 bp, Artificial Sequence
  Description of Artificial Sequence: Synthetic probe
ttttaacaatagatttcgaaaaggatgctaagttgacatctaatgaaggagttacgatgc

SEQ ID NO: 18982 - DNA, 60 bp, Artificial Sequence
  Description of Artificial Sequence: Synthetic probe
tgaattgcatgtggtgggtgcgtgtgagcgtgttgcttttgtctctaaggacatgagctt

SEQ ID NO: 18983 - DNA, 59 bp, Artificial Sequence
  Description of Artificial Sequence: Synthetic probe
ttttaacaatagatttcgaaaaggatgctaagttgacatctaatgaaggagttacgatg

SEQ ID NO: 18984 - DNA, 60 bp, Artificial Sequence
  Description of Artificial Sequence: Synthetic probe
ggatcaggagagatttaaaatgcataaaatccttaagtcacaaggaaatgttttaacaat

SEQ ID NO: 18985 - DNA, 50 bp, Artificial Sequence
  Description of Artificial Sequence: Synthetic probe
ctatcgtaacgaagtttgatgatgtggcgtatggacagatggtgagtgat

SEQ ID NO: 18986 - DNA, 51 bp, Artificial Sequence
  Description of Artificial Sequence: Synthetic probe
tcaacagactaaggacatcacttatgagcaaggtaacccttgcgatttatt

SEQ ID NO: 18987 - DNA, 60 bp, Artificial Sequence
  Description of Artificial Sequence: Synthetic probe
gcgtgtgcaggttaattatggtcctacgggggagccgttggatttccagatcggcagaaa

SEQ ID NO: 18988 - DNA, 60 bp, Artificial Sequence
  Description of Artificial Sequence: Synthetic probe
aacggaggcgtatcgtgaatttctcaatctatcaatctcaaacacgtatagtagcgctat

SEQ ID NO: 18989 - DNA, 60 bp, Artificial Sequence
  Description of Artificial Sequence: Synthetic probe
atatggttaagaaagaggtcatgaagaaacaatcgtataatgatgcggtgaggatgagtt

SEQ ID NO: 18990 - DNA, 60 bp, Artificial Sequence
  Description of Artificial Sequence: Synthetic probe
gctcgaggattaccgcaaaagtgggatgatggatgaagccgtgaagcaatccgcgttggt

SEQ ID NO: 18991 - DNA, 60 bp, Artificial Sequence
  Description of Artificial Sequence: Synthetic probe
gaattactatagaaggggtcatgagtcaaaagaaactgctaagcatgattggtggtgtgg

SEQ ID NO: 18992 - DNA, 60 bp, Artificial Sequence
  Description of Artificial Sequence: Synthetic probe
ccaggacaaattatactcgatcttaagattgaccctggtgaaaggatggatccagcagta

SEQ ID NO: 18993 - DNA, 60 bp, Artificial Sequence
  Description of Artificial Sequence: Synthetic probe
gagcgagatggaatgcaggaggaggcgatccaggagattgccggaatgactgcggatgtc

SEQ ID NO: 18994 - DNA, 60 bp, Artificial Sequence
  Description of Artificial Sequence: Synthetic probe
tgtttatactgttttgagacctgagttcgcgattcatggcgtaaacccaatgcctgggcc

SEQ ID NO: 18995 - DNA, 60 bp, Artificial Sequence
  Description of Artificial Sequence: Synthetic probe
ggattacaacaacggggccgttcgctattctgaccgggtcgactccaactgcgcagcaac

SEQ ID NO: 18996 - DNA, 60 bp, Artificial Sequence
  Description of Artificial Sequence: Synthetic probe
ggtgggaagagtggaagtttgagggcgtcagtgtgacgccaatggctactagggtacagc

SEQ ID NO: 18997 - DNA, 60 bp, Artificial Sequence
  Description of Artificial Sequence: Synthetic probe
gattatacccaacatatggctacaatcggtgtactagcaacgccagagataccttttacg

SEQ ID NO: 18998 - DNA, 60 bp, Artificial Sequence
  Description of Artificial Sequence: Synthetic probe
cgcatgacgttgttggttgccgctgtcgtagcattgttgacgtcggtatgcacgccttca

SEQ ID NO: 18999 - DNA, 60 bp, Artificial Sequence
  Description of Artificial Sequence: Synthetic probe
cgcatgacgttgttggtagccgctgtcgtagcattgttgacgtcggtatgcacgctttca

SEQ ID NO: 19000 - DNA, 60 bp, Artificial Sequence
  Description of Artificial Sequence: Synthetic probe
tacgcatgacgttgttggttgccgctgtcgtagcattgttgacgtcggtatgcacgcctt

SEQ ID NO: 19001 - DNA, 60 bp, Artificial Sequence
  Description of Artificial Sequence: Synthetic probe
tatcatacgcatgacgttgttggtagccgctgtcgtagcattgttgacgtcggtatgcac

SEQ ID NO: 19002 - DNA, 60 bp, Artificial Sequence
  Description of Artificial Sequence: Synthetic probe
caaccaccgagatatgctccgagtgccccaacgccgtcatcaatgccaaccgttgccctt

SEQ ID NO: 19003 - DNA, 60 bp, Artificial Sequence
  Description of Artificial Sequence: Synthetic probe
ggcaccaagctggctgcgccaactgtgtagatgcgcgaccaatctatgcacttggtagcg

SEQ ID NO: 19004 - DNA, 60 bp, Artificial Sequence
  Description of Artificial Sequence: Synthetic probe
ggtgaaaggatggatccagcagtaagaatggttgcaggcgttgtaggtcatctgcttttc

SEQ ID NO: 19005 - DNA, 60 bp, Artificial Sequence
  Description of Artificial Sequence: Synthetic probe
caatttcttgaggatggatgattttgcgaagcattttaacaggtatgcttcgatggcgat

SEQ ID NO: 19006 - DNA, 60 bp, Artificial Sequence
  Description of Artificial Sequence: Synthetic probe
attcgcatcgtacgcagaagcgtttcgtgatgatgtgaggctaagacagattaagcgcca

SEQ ID NO: 19007 - DNA, 60 bp, Artificial Sequence
  Description of Artificial Sequence: Synthetic probe
tccaagagctcaacagccgcagattcatgtatacagtgccccatgggattctgatgatgt

SEQ ID NO: 19008 - DNA, 60 bp, Artificial Sequence
  Description of Artificial Sequence: Synthetic probe
gatgaagtttaagattccaagagctcaacagccgcagattcatgtatacagtgccccatg

SEQ ID NO: 19009 - DNA, 60 bp, Artificial Sequence
  Description of Artificial Sequence: Synthetic probe
agattgcggggatgaccgcagatgtgttagaggcggcatcggaggaggtccctctgattg

SEQ ID NO: 19010 - DNA, 60 bp, Artificial Sequence
  Description of Artificial Sequence: Synthetic probe
tacaagagattgcggggatgaccgcagatgtgttagaggcggcatcggaggaggtccctc

SEQ ID NO: 19011 - DNA, 60 bp, Artificial Sequence
  Description of Artificial Sequence: Synthetic probe
aggcgatacaggagatcgcggggatgaccgcagatgtgttagaggcggcatcggaggagg

SEQ ID NO: 19012 - DNA, 60 bp, Artificial Sequence
  Description of Artificial Sequence: Synthetic probe
gcggcagttgtcgctctgttgacatcggtttgcacgttgtcgagtgatatgagcgtggca

SEQ ID NO: 19013 - DNA, 60 bp, Artificial Sequence
  Description of Artificial Sequence: Synthetic probe
gttcccagtatttcgttcagacatatcgtaatgcagtcaagagatcgagtcttacgagta

SEQ ID NO: 19014 - DNA, 60 bp, Artificial Sequence
  Description of Artificial Sequence: Synthetic probe
gtaaacaagggaagaagcctcatggtgatgcgcagaaagaaggcaccgaggaagagaaga

SEQ ID NO: 19015 - DNA, 60 bp, Artificial Sequence
  Description of Artificial Sequence: Synthetic probe
atggagttgaagcgacaacggaaagatgggaagagtggaagtttgagggtgttagtgtga

SEQ ID NO: 19016 - DNA, 60 bp, Artificial Sequence
  Description of Artificial Sequence: Synthetic probe
tgtttacactgttttgagaccagagtttgcgattcacggcgtaaatccgatgccggggcc

SEQ ID NO: 19017 - DNA, 60 bp, Artificial Sequence
  Description of Artificial Sequence: Synthetic probe
gttagggccatactatgacctacgcctacagttattcggcgacgccctcagtttggaaca

SEQ ID NO: 19018 - DNA, 60 bp, Artificial Sequence
  Description of Artificial Sequence: Synthetic probe
gctatttcaccacaatggacttgcagtcatctaaaaaggaattgtttattcaatgggatg

SEQ ID NO: 19019 - DNA, 60 bp, Artificial Sequence
  Description of Artificial Sequence: Synthetic probe
cgcggtgaggatgagttttacagagttctcgtcaatcccgctagatggtttcgaaatgcc

SEQ ID NO: 19020 - DNA, 51 bp, Artificial Sequence
  Description of Artificial Sequence: Synthetic probe
cgtctatagctttagagatcatacttggcatggattgagaaccgctatatt

SEQ ID NO: 19021 - DNA, 51 bp, Artificial Sequence
  Description of Artificial Sequence: Synthetic probe
cgtctatagctttagagatcatacttggcatgggttgagaaccgctatatt

SEQ ID NO: 19022 - DNA, 60 bp, Artificial Sequence
  Description of Artificial Sequence: Synthetic probe
gcagaaatatttaacgtctatagctttagagatcatacttggcatggattgagaaccgct

SEQ ID NO: 19023 - DNA, 60 bp, Artificial Sequence
  Description of Artificial Sequence: Synthetic probe
acgcgcagcatatggcgacaattggagtgctagcaacgccagagattcctttcacaacag

SEQ ID NO: 19024 - DNA, 60 bp, Artificial Sequence
  Description of Artificial Sequence: Synthetic probe
gtgttctcctactcgcagaagatggggaagataattaaatcgctaagtagatttggaaaa

SEQ ID NO: 19025 - DNA, 60 bp, Artificial Sequence
  Description of Artificial Sequence: Synthetic probe
cattcgcatcgtacgcagaagcgtttcgtgatgatgtgaggctaagacagatcaaacgtc

SEQ ID NO: 19026 - DNA, 60 bp, Artificial Sequence
  Description of Artificial Sequence: Synthetic probe
ggccggaatttgcgattcacggcgtaaatccgatgccagggccgctcacacgtgctattg

SEQ ID NO: 19027 - DNA, 60 bp, Artificial Sequence
  Description of Artificial Sequence: Synthetic probe
aacccaatgcctgggccgctcacacgtgctattgcacgcgccgcctatgtgtagtccact

SEQ ID NO: 19028 - DNA, 60 bp, Artificial Sequence
  Description of Artificial Sequence: Synthetic probe
cgcagatggatgatgatgagtgggagtcgaccagattcgcagaggataggttgggtgaag

SEQ ID NO: 19029 - DNA, 60 bp, Artificial Sequence
  Description of Artificial Sequence: Synthetic probe
gatcaagggatggtgaggggacgcaatcggagagcggccagaaggaagagggcggcaaag

SEQ ID NO: 19030 - DNA, 60 bp, Artificial Sequence
  Description of Artificial Sequence: Synthetic probe
ccctggtgaaaggatggatccagcagtaagaatggtcgcgggcgttgtgggtcatctgct

SEQ ID NO: 19031 - DNA, 60 bp, Artificial Sequence
  Description of Artificial Sequence: Synthetic probe
ggggtgcaactgctcgaggattaccgcaaaagtgggatgatggatgaggccgtgaagcaa

SEQ ID NO: 19032 - DNA, 60 bp, Artificial Sequence
  Description of Artificial Sequence: Synthetic probe
gtctccagaaagagttggggatttcccgtgagggggtggccgagcagacggagagattga

SEQ ID NO: 19033 - DNA, 60 bp, Artificial Sequence
  Description of Artificial Sequence: Synthetic probe
gtctccagaaagagttgggaatctcccgtgagggggtggccgagcagacggagagattga

SEQ ID NO: 19034 - DNA, 60 bp, Artificial Sequence
  Description of Artificial Sequence: Synthetic probe
ggacactatcgcagcaagagcgctcactgtgatgcgggcatgtgccactttacaagaagc

SEQ ID NO: 19035 - DNA, 60 bp, Artificial Sequence
  Description of Artificial Sequence: Synthetic probe
tggcgacgattggagtgctagcaacgccagagatccctttcacgacggaggctgcgaatg

SEQ ID NO: 19036 - DNA, 60 bp, Artificial Sequence
  Description of Artificial Sequence: Synthetic probe
tctgcttttcacggcgggaggacgatttactaacctaactcagaacatggctcgtcaatt

SEQ ID NO: 19037 - DNA, 60 bp, Artificial Sequence
  Description of Artificial Sequence: Synthetic probe
gatgtaagttggatatcgctttggtttgcctttaatcggtcgtttgagccaacgcatcgt

SEQ ID NO: 19038 - DNA, 60 bp, Artificial Sequence
  Description of Artificial Sequence: Synthetic probe
tgcgatcgagattgaacgagacggaatgcaggaggaggcgatccaggagattgctggaat

SEQ ID NO: 19039 - DNA, 60 bp, Artificial Sequence
  Description of Artificial Sequence: Synthetic probe
aacaggcagttcttctcaacgtgttaggtacaggtgaagagttaccagatccactgagcc

SEQ ID NO: 19040 - DNA, 60 bp, Artificial Sequence
  Description of Artificial Sequence: Synthetic probe
tggagagtcagttaaacaagcagttcttctcaacgtgttaggtacaggtgaagagttacc

SEQ ID NO: 19041 - DNA, 60 bp, Artificial Sequence
  Description of Artificial Sequence: Synthetic probe
cagcggtagtgtgcggtccggatatgattcaagtgtcactgaatgctggggcaagaggag

SEQ ID NO: 19042 - DNA, 60 bp, Artificial Sequence
  Description of Artificial Sequence: Synthetic probe
tgcaaagcagattaaattgaaggatgaacggttcatgagtctatcaagtgctatgcctca

SEQ ID NO: 19043 - DNA, 60 bp, Artificial Sequence
  Description of Artificial Sequence: Synthetic probe
tatagagtttcaagggagatgactgaagtggaaaaatttatcgaatcccgtgctaaaaac

SEQ ID NO: 19044 - DNA, 60 bp, Artificial Sequence
  Description of Artificial Sequence: Synthetic probe
tgcattcgcatcgtacgcagaagcgtttcgtgatgatgtgaggttgagacagattaaacg

SEQ ID NO: 19045 - DNA, 60 bp, Artificial Sequence
  Description of Artificial Sequence: Synthetic probe
gaaaatacaacatcagtggggattacgcaaatgccacgagaacttttttggctatttcac

SEQ ID NO: 19046 - DNA, 60 bp, Artificial Sequence
  Description of Artificial Sequence: Synthetic probe
gagagattgagagatctgcggcggaaagagaagaatgggacgcatgctaaagccgttgag

SEQ ID NO: 19047 - DNA, 60 bp, Artificial Sequence
  Description of Artificial Sequence: Synthetic probe
ccctgatgtttccgggacagattatactcgatctaaagattgaccctggtgaaaggatgg

SEQ ID NO: 19048 - DNA, 60 bp, Artificial Sequence
  Description of Artificial Sequence: Synthetic probe
gctgcggcgaatgattttgaagatttgatgctgactgatcaagtatatatgcacagagat

SEQ ID NO: 19049 - DNA, 60 bp, Artificial Sequence
  Description of Artificial Sequence: Synthetic probe
gcgtggcatttaagctaaatggtacatcagctgagatacctcaatggtttaagagtttga

SEQ ID NO: 19050 - DNA, 60 bp, Artificial Sequence
  Description of Artificial Sequence: Synthetic probe
gagcgtgagacctgaatataaaccgcgagatttggagcgggaacaggaaaaatacatcgt

SEQ ID NO: 19051 - DNA, 60 bp, Artificial Sequence
  Description of Artificial Sequence: Synthetic probe
cgctagatggtttcgaactgccattaacctaagatcagtaggtagagtggcgccctgagg

SEQ ID NO: 19052 - DNA, 60 bp, Artificial Sequence
  Description of Artificial Sequence: Synthetic probe
aaaggtggatgaagaggctaaagagatgattccgggaaccagcagattggagaagctgcg

SEQ ID NO: 19053 - DNA, 60 bp, Artificial Sequence
  Description of Artificial Sequence: Synthetic probe
aaaagtggatgaagaggctaaagagatgattccgggaaccagcagattggagaagctgcg

SEQ ID NO: 19054 - DNA, 60 bp, Artificial Sequence
  Description of Artificial Sequence: Synthetic probe
gagccacacgcagtactctatgtcacaaatgagctctctcatatcgttaaggatggattt

SEQ ID NO: 19055 - DNA, 60 bp, Artificial Sequence
  Description of Artificial Sequence: Synthetic probe
cagaggcagattcaaattaatttagttgattggacagaaagtgagaacggaaaagagggt

SEQ ID NO: 19056 - DNA, 60 bp, Artificial Sequence
  Description of Artificial Sequence: Synthetic probe
gctgcattcgcatcgtacgcagaagcgtttcgtgatgatgtgaggctaagacagatcaaa

SEQ ID NO: 19057 - DNA, 51 bp, Artificial Sequence
  Description of Artificial Sequence: Synthetic probe
cactctttctaaaaaacgcgtgacagcggtgatcccgggacttacacttac

SEQ ID NO: 19058 - DNA, 52 bp, Artificial Sequence
  Description of Artificial Sequence: Synthetic probe
ccactctttctaaaaaacgcgtgacagcggtgatcccgggacttacacttac

SEQ ID NO: 19059 - DNA, 60 bp, Artificial Sequence
  Description of Artificial Sequence: Synthetic probe
gggcgcgctcaaattcggagtgaaagtgcttggcgacaagatagatgtgccactctttct

SEQ ID NO: 19060 - DNA, 60 bp, Artificial Sequence
  Description of Artificial Sequence: Synthetic probe
cgatctacctaggatccatgcattatgacatcacttacgaaacgttaaaatcgaatgcgc

SEQ ID NO: 19061 - DNA, 60 bp, Artificial Sequence
  Description of Artificial Sequence: Synthetic probe
atccgatctacctaggatccatgcattatgacatcacttacgaaacgttaaaatcgaatg

SEQ ID NO: 19062 - DNA, 60 bp, Artificial Sequence
  Description of Artificial Sequence: Synthetic probe
ttatacgtcaccaatgcatgcgaggcgtatgattagatcaaagacagtccatccgatcta

SEQ ID NO: 19063 - DNA, 60 bp, Artificial Sequence
  Description of Artificial Sequence: Synthetic probe
atctatcggtagcgcttatacgtcaccaatgcatgcgaggcgtatgattagatcaaagac

SEQ ID NO: 19064 - DNA, 60 bp, Artificial Sequence
  Description of Artificial Sequence: Synthetic probe
gaacttatctatcggcagcgcttatacgtcaccaatgcatgcgaggcgtatgattagatc

SEQ ID NO: 19065 - DNA, 60 bp, Artificial Sequence
  Description of Artificial Sequence: Synthetic probe
tttgaacttatctatcggcagcgcttatacgtcaccaatgcatgcgaggcgtatgattag

SEQ ID NO: 19066 - DNA, 60 bp, Artificial Sequence
  Description of Artificial Sequence: Synthetic probe
ggagtttttgaatttatctatcggtagcgcttatacgtcaccaatgcatgcgaggcgtat

SEQ ID NO: 19067 - DNA, 60 bp, Artificial Sequence
  Description of Artificial Sequence: Synthetic probe
atgaggagaaagaattagaagggatcgatgataagaagatacatccgagagtaatgatga

SEQ ID NO: 19068 - DNA, 51 bp, Artificial Sequence
  Description of Artificial Sequence: Synthetic probe
gttcaggaatggcaacggccatagcaacgggacgagcgattgaaggtgcat

SEQ ID NO: 19069 - DNA, 56 bp, Artificial Sequence
  Description of Artificial Sequence: Synthetic probe
gcaagaggaggccatccaagagatcgcgggtatgacagctgacgtattggaagcag

SEQ ID NO: 19070 - DNA, 60 bp, Artificial Sequence
  Description of Artificial Sequence: Synthetic probe
ggttaactcgtatgagaaattacttctagccgaaaatgacgagatgcgtacgctagcgcg

SEQ ID NO: 19071 - DNA, 60 bp, Artificial Sequence
  Description of Artificial Sequence: Synthetic probe
ggaggaaatatatcagtttatgaacggcgaggtgaaagaggaggttcagcaggaggagca

SEQ ID NO: 19072 - DNA, 60 bp, Artificial Sequence
  Description of Artificial Sequence: Synthetic probe
agttggaggaaatatatcagtttatgaacggcgaggtgaaagaggaagttcagcaggagg

SEQ ID NO: 19073 - DNA, 60 bp, Artificial Sequence
  Description of Artificial Sequence: Synthetic probe
cgatgagttggaggaaatatatcagtttatgaacggcgaggtgaaagaggaagttcagca

SEQ ID NO: 19074 - DNA, 60 bp, Artificial Sequence
  Description of Artificial Sequence: Synthetic probe
ggcgatgagttggaggaaatatatcagtttatgaacggcgaggtgaaagaggaggttcag

SEQ ID NO: 19075 - DNA, 60 bp, Artificial Sequence
  Description of Artificial Sequence: Synthetic probe
gtgcactcaattatgacgggagagtcttacggtgaatcggtcaaacaggcagtactgttg

SEQ ID NO: 19076 - DNA, 60 bp, Artificial Sequence
  Description of Artificial Sequence: Synthetic probe
cagtgtgcactcaattatgacgggagagtcttacggtgaatcggtcaaacaggcagtact

SEQ ID NO: 19077 - DNA, 60 bp, Artificial Sequence
  Description of Artificial Sequence: Synthetic probe
gctgagagtgagatcggatcagccgcgatcgatgggctagttcaaggcagtgtgcactca

SEQ ID NO: 19078 - DNA, 60 bp, Artificial Sequence
  Description of Artificial Sequence: Synthetic probe
gctgagagtgagatcggatcagccgcaatcgatgggctagttcaaggcagtgtgcactca

SEQ ID NO: 19079 - DNA, 60 bp, Artificial Sequence
  Description of Artificial Sequence: Synthetic probe
cctcgggaggttgcaaggagccatgatatgaaagcttttgaaaatgagatcagcagacgc

SEQ ID NO: 19080 - DNA, 60 bp, Artificial Sequence
  Description of Artificial Sequence: Synthetic probe
gctggggcgcatcagaacgccgacccagttgtgctagatgtgagttggatatcgctgtgg

SEQ ID NO: 19081 - DNA, 60 bp, Artificial Sequence
  Description of Artificial Sequence: Synthetic probe
gagttgcagtgtgtgggtgcgtgtgagcgtgttgcttttgtctctaaagacatgagcttg

SEQ ID NO: 19082 - DNA, 60 bp, Artificial Sequence
  Description of Artificial Sequence: Synthetic probe
ggcactaagctggctgcgccgactgtgtagagatgcgacctatctgtgcactcggtagca

SEQ ID NO: 19083 - DNA, 60 bp, Artificial Sequence
  Description of Artificial Sequence: Synthetic probe
tgagggagtggccgagcagacagagagattgagggacctgcggcgaaaagagaagagtgg

SEQ ID NO: 19084 - DNA, 53 bp, Artificial Sequence
  Description of Artificial Sequence: Synthetic probe
atgtcagctatgctatctgaaacattcaaagcagatgcaaacatgtggtgtga

SEQ ID NO: 19085 - DNA, 60 bp, Artificial Sequence
  Description of Artificial Sequence: Synthetic probe
attatatggacagaaagcatacatgtcagctatgctatctgaaacattcaaagcagatgc

SEQ ID NO: 19086 - DNA, 51 bp, Artificial Sequence
  Description of Artificial Sequence: Synthetic probe
attcaggctacaaaggtagggtttttcaagtgatgtttctaccaatccaaa

SEQ ID NO: 19087 - DNA, 60 bp, Artificial Sequence
  Description of Artificial Sequence: Synthetic probe
gaggaaccacggaaagcatttcaattggttgaattggctaaagaggcgatgtatgatcga

SEQ ID NO: 19088 - DNA, 60 bp, Artificial Sequence
  Description of Artificial Sequence: Synthetic probe
gcaactgatgctgaggaaccacggaaagcatttcaattggttgaattggctaaagaggcg

SEQ ID NO: 19089 - DNA, 60 bp, Artificial Sequence
  Description of Artificial Sequence: Synthetic probe
gcaatgattgcagcaactgatgctgaggaaccacggaaagcatttcaattggttgaattg

SEQ ID NO: 19090 - DNA, 60 bp, Artificial Sequence
  Description of Artificial Sequence: Synthetic probe
caaacaaaattttgaaagagcaatgattgcagcaactgatgctgaggaaccacggaaagc

SEQ ID NO: 19091 - DNA, 60 bp, Artificial Sequence
  Description of Artificial Sequence: Synthetic probe
tggcgacgattggagtgctagcaacgccagagattcctttcacaacagaagctgcgaatg

SEQ ID NO: 19092 - DNA, 60 bp, Artificial Sequence
  Description of Artificial Sequence: Synthetic probe
cctcaacatgggggccagcgcgtcagccttatggttttttccttgaaactgaggagacct

SEQ ID NO: 19093 - DNA, 60 bp, Artificial Sequence
  Description of Artificial Sequence: Synthetic probe
aaacaatcgtataatgatgcggtgaggatgagttttacggagttttcatcagtcccgcta

SEQ ID NO: 19094 - DNA, 60 bp, Artificial Sequence
  Description of Artificial Sequence: Synthetic probe
gaaacaatcgtataatgatgcggtgaggatgagttttacggaattttcgtcagtcccgct

SEQ ID NO: 19095 - DNA, 60 bp, Artificial Sequence
  Description of Artificial Sequence: Synthetic probe
tttcgagcagatttcgccacgggaacaggatataatggttgggcgacgattgatgttgag

SEQ ID NO: 19096 - DNA, 60 bp, Artificial Sequence
  Description of Artificial Sequence: Synthetic probe
tattgccggtcggcgtttaggcgcttgtgaccgcgtggttagggggggattttacactta

SEQ ID NO: 19097 - DNA, 60 bp, Artificial Sequence
  Description of Artificial Sequence: Synthetic probe
atggttcatgcgcgccgctcaagcggtgactgcagtggtgtgcggtccggatatgattca

SEQ ID NO: 19098 - DNA, 60 bp, Artificial Sequence
  Description of Artificial Sequence: Synthetic probe
gactaactttacgtggggtaacgatgcgcccgacttcgttagcgcaaagaaatgagatgt

SEQ ID NO: 19099 - DNA, 60 bp, Artificial Sequence
  Description of Artificial Sequence: Synthetic probe
gggaggagatgtgaaaacggagttcctgcatttgatcgatcacctctaaagggtccaggg

SEQ ID NO: 19100 - DNA, 60 bp, Artificial Sequence
  Description of Artificial Sequence: Synthetic probe
cgacgccagagataccctttacaacggaagcggcgaatgagattgctcgcgtgacagggg

SEQ ID NO: 19101 - DNA, 55 bp, Artificial Sequence
  Description of Artificial Sequence: Synthetic probe
cggtcggcgtttaggcgcttgtgaccgcgtggttagggggggattttacacttac

SEQ ID NO: 19102 - DNA, 60 bp, Artificial Sequence
  Description of Artificial Sequence: Synthetic probe
cctactcgcagaagatggggaagataattaaatcgctaagtagatttgggaagaaggttg

SEQ ID NO: 19103 - DNA, 60 bp, Artificial Sequence
  Description of Artificial Sequence: Synthetic probe
tgcattcgcatcgtacgcagaagcgtttcgtgatgacgtgaggttgagacagattaaacg

SEQ ID NO: 19104 - DNA, 60 bp, Artificial Sequence
  Description of Artificial Sequence: Synthetic probe
agacgctcaaccagtaccctgcattgacggcagaaatatttaatgtgtacagctttagag

SEQ ID NO: 19105 - DNA, 58 bp, Artificial Sequence
  Description of Artificial Sequence: Synthetic probe
acgcttaaccagtaccctgcattaacggcagaaatatttaatgtgtacagctttagag

SEQ ID NO: 19106 - DNA, 60 bp, Artificial Sequence
  Description of Artificial Sequence: Synthetic probe
gcggtgaggatgagtttcacagagttctcgtcagtcccgctagatggtttcgaattacca

SEQ ID NO: 19107 - DNA, 60 bp, Artificial Sequence
  Description of Artificial Sequence: Synthetic probe
acacatggcatggattaagaacggcaatattaaacagaaccacactgccaaacatgctgc

SEQ ID NO: 19108 - DNA, 60 bp, Artificial Sequence
  Description of Artificial Sequence: Synthetic probe
tgcctggcccgcttacacgtgcgattgctcgcgccgcttacgcatagtccactttgcacg

SEQ ID NO: 19109 - DNA, 60 bp, Artificial Sequence
  Description of Artificial Sequence: Synthetic probe
aatgcctggcccgcttacacgtgcgattgctcgcgccgcttacgcatagtccactttgca

SEQ ID NO: 19110 - DNA, 60 bp, Artificial Sequence
  Description of Artificial Sequence: Synthetic probe
atgcggtgaggatgagttttacggaattttcatcagtcccgctagatggtttcgaattac

SEQ ID NO: 19111 - DNA, 60 bp, Artificial Sequence
  Description of Artificial Sequence: Synthetic probe
agattgatgtgccactctttctaaaaaacgcgtgacagcggtgatcccgggacttacact

SEQ ID NO: 19112 - DNA, 53 bp, Artificial Sequence
  Description of Artificial Sequence: Synthetic probe
aagaactgatgcatattaagaatgagatattaccgagatttaagaaagcgatg

SEQ ID NO: 19113 - DNA, 57 bp, Artificial Sequence
  Description of Artificial Sequence: Synthetic probe
caactgtgtagatgtgcgaccaatctatgcacttggtagcggcagcggaaacacact

SEQ ID NO: 19114 - DNA, 60 bp, Artificial Sequence
  Description of Artificial Sequence: Synthetic probe
gaaatgacgaaatgctgacgaagctgctcaatgtttaacctcagtgacatggggttcacg

SEQ ID NO: 19115 - DNA, 60 bp, Artificial Sequence
  Description of Artificial Sequence: Synthetic probe
ggggcattgcgatccttacgatcgggaagaatagaatggttgacgcttacacagagggga

SEQ ID NO: 19116 - DNA, 60 bp, Artificial Sequence
  Description of Artificial Sequence: Synthetic probe
agattacgcgcgaggttccctttgagttctatacacttaaggggcattgcgatccttacg

SEQ ID NO: 19117 - DNA, 60 bp, Artificial Sequence
  Description of Artificial Sequence: Synthetic probe
ttgcgatcgagttcgcggacaataaagttagcgcggtttataggtgcaatagattacgcg

SEQ ID NO: 19118 - DNA, 60 bp, Artificial Sequence
  Description of Artificial Sequence: Synthetic probe
gtggtgggttctcggagggattagtttggtatcttccaatcacgcatcctacaaagtgtg

SEQ ID NO: 19119 - DNA, 60 bp, Artificial Sequence
  Description of Artificial Sequence: Synthetic probe
cttgatacgacaatattctctggtggcatacagagtagcgtggtctcgactaagcagatc

SEQ ID NO: 19120 - DNA, 60 bp, Artificial Sequence
  Description of Artificial Sequence: Synthetic probe
ggaccgttcgactagatgaggctgaagtgaaggtaagcaagttaattttagacttctatc

SEQ ID NO: 19121 - DNA, 60 bp, Artificial Sequence
  Description of Artificial Sequence: Synthetic probe
gtctgtcccggtcattctgcacgccgacgttatgtggtttattccggttgaagttggggc

SEQ ID NO: 19122 - DNA, 60 bp, Artificial Sequence
  Description of Artificial Sequence: Synthetic probe
tgatgggagataacgtctcgtatgaacataggcaatggtctgtcccggtcattctgcacg

SEQ ID NO: 19123 - DNA, 60 bp, Artificial Sequence
  Description of Artificial Sequence: Synthetic probe
gttcgtagtgtggatgaatcaaggtgggtcatagaaacgattagacgtgctagaggtaga

SEQ ID NO: 19124 - DNA, 60 bp, Artificial Sequence
  Description of Artificial Sequence: Synthetic probe
gcgtgcgtggattcaccagttgggactgataggattgtcgatgtcacacagttgatcgta

SEQ ID NO: 19125 - DNA, 60 bp, Artificial Sequence
  Description of Artificial Sequence: Synthetic probe
gacaagccgtgtccattaaccacgtgtgcttatattctcgagaagacagctctattgtgg

SEQ ID NO: 19126 - DNA, 60 bp, Artificial Sequence
  Description of Artificial Sequence: Synthetic probe
gaagacatactgacacgccggggtttgcgtaaagctgacaagccgtgtccattaaccacg

SEQ ID NO: 19127 - DNA, 60 bp, Artificial Sequence
  Description of Artificial Sequence: Synthetic probe
cgcgctctctaagaaacaggaacagtcggcttatcacgcggctctcgtgaaagagaagga

SEQ ID NO: 19128 - DNA, 60 bp, Artificial Sequence
  Description of Artificial Sequence: Synthetic probe
gcacccataggctcaaacccattcactctacaacggttgtgccttggaaattactatgat

SEQ ID NO: 19129 - DNA, 60 bp, Artificial Sequence
  Description of Artificial Sequence: Synthetic probe
ccgagatagcgcaggcaaagaatgacgatccatacgtcataagaacgcttgcacccatag

SEQ ID NO: 19130 - DNA, 60 bp, Artificial Sequence
  Description of Artificial Sequence: Synthetic probe
tgatcaacgaattactaaatggggggtggaacacacgcgaatttaagatgtacaaattgt

SEQ ID NO: 19131 - DNA, 60 bp, Artificial Sequence
  Description of Artificial Sequence: Synthetic probe
cctggtgataaagtcgttcattggaggtatgagttgatctcacagacgaagaagactacg

SEQ ID NO: 19132 - DNA, 60 bp, Artificial Sequence
  Description of Artificial Sequence: Synthetic probe
catcagaaacgaggttgggcgatgtttactggactctaagacacacttacgattggagcg

SEQ ID NO: 19133 - DNA, 60 bp, Artificial Sequence
  Description of Artificial Sequence: Synthetic probe
acctataatggcagaatatggtggacaaatccgtacccttgcttgcgtggagcattgatc

SEQ ID NO: 19134 - DNA, 60 bp, Artificial Sequence
  Description of Artificial Sequence: Synthetic probe
cgaggcatattcgctcgctggaactatgtcggattctgtcaagtgtcggaaggaaggtgg

SEQ ID NO: 19135 - DNA, 60 bp, Artificial Sequence
  Description of Artificial Sequence: Synthetic probe
gacgaaattgcgtgtgcagggcaaagtgccacctcagatacaggatgaaattcagcagct

SEQ ID NO: 19136 - DNA, 60 bp, Artificial Sequence
  Description of Artificial Sequence: Synthetic probe
taggagatgagccatataagaagacattacagggattgacgaaattgcgtgtgcagggca

SEQ ID NO: 19137 - DNA, 60 bp, Artificial Sequence
  Description of Artificial Sequence: Synthetic probe
cgtaccgtttcagctggttggacagaattacgtttcgatcgggagaaatcatcgattggt

SEQ ID NO: 19138 - DNA, 60 bp, Artificial Sequence
  Description of Artificial Sequence: Synthetic probe
atggagataattgtacactctgagagagcctcgactgacgtaccgtttcagctggttgga

SEQ ID NO: 19139 - DNA, 60 bp, Artificial Sequence
  Description of Artificial Sequence: Synthetic probe
ggcacgaagtaatgcactgcgcacaggagagtgcctatgtcctgaaaccaactatggaga

SEQ ID NO: 19140 - DNA, 60 bp, Artificial Sequence
  Description of Artificial Sequence: Synthetic probe
aagaaggcagatacatcttcatatcacatcgaggcgattggtgacacaggtaaggcgtgc

SEQ ID NO: 19141 - DNA, 60 bp, Artificial Sequence
  Description of Artificial Sequence: Synthetic probe
cgccgaaggagtggctaaattggatgatccacgactcaatggacgtgcaacctttaaagg

SEQ ID NO: 19142 - DNA, 60 bp, Artificial Sequence
  Description of Artificial Sequence: Synthetic probe
cggatgttccgattcgtgaagcgctaagggttttacctcaaaggaatgatggtcacgtgc

SEQ ID NO: 19143 - DNA, 60 bp, Artificial Sequence
  Description of Artificial Sequence: Synthetic probe
gggcatttccccaaagaagcactaattgagtatgactgcatagtagaattgaatgcgccg

SEQ ID NO: 19144 - DNA, 60 bp, Artificial Sequence
  Description of Artificial Sequence: Synthetic probe
gacgggaacaggatataatggttgggcgacgattgatgttgagtatagagaacctgcgcc

SEQ ID NO: 19145 - DNA, 60 bp, Artificial Sequence
  Description of Artificial Sequence: Synthetic probe
tcgagcagatttcgcgacgggaacaggatataatggttgggcgacgattgatgttgagta

SEQ ID NO: 19146 - DNA, 60 bp, Artificial Sequence
  Description of Artificial Sequence: Synthetic probe
cctggtgagaggatggatccggcggtaagaatggtcgctggcgttgtaggccatttgctc

SEQ ID NO: 19147 - DNA, 60 bp, Artificial Sequence
  Description of Artificial Sequence: Synthetic probe
gaatccaatgttgggtgtgataaatctgggagctaccttcctgatgatggtttgtgcaaa

SEQ ID NO: 19148 - DNA, 60 bp, Artificial Sequence
  Description of Artificial Sequence: Synthetic probe
aaatgccattaacctgaggacagtaggtagagtggcgccccaaggtttacgtcgtgcagg

SEQ ID NO: 19149 - DNA, 60 bp, Artificial Sequence
  Description of Artificial Sequence: Synthetic probe
gatatgataaagaaggaagtgatgaaaaaacaatcttataatgacgcggtgaggatgact

SEQ ID NO: 19150 - DNA, 60 bp, Artificial Sequence
  Description of Artificial Sequence: Synthetic probe
cgcattattacccgaccttatcgctggggcgcatcagaacgctgacccagttgtgctaga

SEQ ID NO: 19151 - DNA, 60 bp, Artificial Sequence
  Description of Artificial Sequence: Synthetic probe
gcagatcccgacctgtggtgtgattgatgtgcgcgcatcagagctaactgggtgttcgcc

SEQ ID NO: 19152 - DNA, 60 bp, Artificial Sequence
  Description of Artificial Sequence: Synthetic probe
agtttatgatgaggagctgcaaatgcatattctaagagggcctttgcacttccagcgtcg

SEQ ID NO: 19153 - DNA, 60 bp, Artificial Sequence
  Description of Artificial Sequence: Synthetic probe
tacatcagctgagatacctcaatggtttaagagtctgaacccaatgttaggtgtggtgaa

SEQ ID NO: 19154 - DNA, 60 bp, Artificial Sequence
  Description of Artificial Sequence: Synthetic probe
gagttacagtgtgtgggtgcgtgtgagcgtgttgcttttgtctctaaggacatgagcttg

SEQ ID NO: 19155 - DNA, 60 bp, Artificial Sequence
  Description of Artificial Sequence: Synthetic probe
gtgtcgctgccatgctatccgagctgatccaaaggttcgaagaagaaaagatgaaacata

SEQ ID NO: 19156 - DNA, 60 bp, Artificial Sequence
  Description of Artificial Sequence: Synthetic probe
caatcccgctggatggtttcgaaatgccattaacctgagggcagtaggtagagtggcgcc

SEQ ID NO: 19157 - DNA, 60 bp, Artificial Sequence
  Description of Artificial Sequence: Synthetic probe
cgtcaatcccgctggatggtttcgaaatgccattaacctaaggacagtaggtagagtggc

SEQ ID NO: 19158 - DNA, 60 bp, Artificial Sequence
  Description of Artificial Sequence: Synthetic probe
aaattctctggtcacgtatttgggaacgatgagatgctaactaaattgctaaacgtttag

SEQ ID NO: 19159 - DNA, 59 bp, Artificial Sequence
  Description of Artificial Sequence: Synthetic probe
cgtactcagaggggatcgtttcgcaccgattgtgtaagaaaaacgttttgggtttcacg

SEQ ID NO: 19160 - DNA, 60 bp, Artificial Sequence
  Description of Artificial Sequence: Synthetic probe
cgaggtatcgtgatactgtccgtttccaagagtagggcgattagcgcgtactcagagggg

SEQ ID NO: 19161 - DNA, 53 bp, Artificial Sequence
  Description of Artificial Sequence: Synthetic probe
gcgatgaccgagtcagcgcgggttacaggtgtgataagctacgatcgaggttt

SEQ ID NO: 19162 - DNA, 60 bp, Artificial Sequence
  Description of Artificial Sequence: Synthetic probe
cttcgctgtgtggaggctttactgagggattagtttggtacctcccaataacgcatccgc

SEQ ID NO: 19163 - DNA, 60 bp, Artificial Sequence
  Description of Artificial Sequence: Synthetic probe
cacatgagaacagtagcgttggatgaagcggaatctaaggtggggaagttgatattagaa

SEQ ID NO: 19164 - DNA, 60 bp, Artificial Sequence
  Description of Artificial Sequence: Synthetic probe
tcgttttggaatcgtatcgtttttagaatatttaaccttcttcccgtctaatcacatgag

SEQ ID NO: 19165 - DNA, 60 bp, Artificial Sequence
  Description of Artificial Sequence: Synthetic probe
cgtacgaacataggcagtggtcggttccgattatattatatgctgataccttatggttcc

SEQ ID NO: 19166 - DNA, 60 bp, Artificial Sequence
  Description of Artificial Sequence: Synthetic probe
ccaattttggagaagcggtctcgcgccttgcatgtcccaaaactgttagagatgtaatgg

SEQ ID NO: 19167 - DNA, 60 bp, Artificial Sequence
  Description of Artificial Sequence: Synthetic probe
ttcgacgcgttactgggaagaagaggctggaggcgatcagtcgcgagtttcccaattttg

SEQ ID NO: 19168 - DNA, 60 bp, Artificial Sequence
  Description of Artificial Sequence: Synthetic probe
cgcgaagtgtggatgaagcgcgatggaccgtacaagtaattcgacgcgttactgggaaga

SEQ ID NO: 19169 - DNA, 60 bp, Artificial Sequence
  Description of Artificial Sequence: Synthetic probe
gtgaacacgtctactcgaatcggtactgagagaatcgttgatatatcacagctagtcgta

SEQ ID NO: 19170 - DNA, 55 bp, Artificial Sequence
  Description of Artificial Sequence: Synthetic probe
aaaacgtagaggataccgtaaagttgagaacccatgtccgctgatcacgtgctcg

SEQ ID NO: 19171 - DNA, 60 bp, Artificial Sequence
  Description of Artificial Sequence: Synthetic probe
agttcggaccctatcgatttacagcgcatgtgtttagctaattactatgacgtaagaccg

SEQ ID NO: 19172 - DNA, 60 bp, Artificial Sequence
  Description of Artificial Sequence: Synthetic probe
gtaaagcagatgacccgagtatatatcgtaccttagcgccaattagttcggaccctatcg

SEQ ID NO: 19173 - DNA, 60 bp, Artificial Sequence
  Description of Artificial Sequence: Synthetic probe
cggtgaaaactacgtatgagagaggcaatatgtgtgatttatttcctgatgtagacggca

SEQ ID NO: 19174 - DNA, 60 bp, Artificial Sequence
  Description of Artificial Sequence: Synthetic probe
gatgccgatccaggtacacagattatacattgggaatataagcctattacaagtacggtg

SEQ ID NO: 19175 - DNA, 60 bp, Artificial Sequence
  Description of Artificial Sequence: Synthetic probe
gattggagcgtcagaccggtatattcaccgagacaaaaggagcgagaagacgataaatac

SEQ ID NO: 19176 - DNA, 60 bp, Artificial Sequence
  Description of Artificial Sequence: Synthetic probe
ggcgccttgatcgcctcagaaacctcacttggggatgtgtattggacgttgagacatttc

SEQ ID NO: 19177 - DNA, 60 bp, Artificial Sequence
  Description of Artificial Sequence: Synthetic probe
cgtatctggtggacaaacccatacccatgcctacgtggcgccttgatcgcctcagaaacc

SEQ ID NO: 19178 - DNA, 60 bp, Artificial Sequence
  Description of Artificial Sequence: Synthetic probe
gagcgtaacgtgatattcacatcaaagggtcaaaggaatgatcagcagcggttcttcgta

SEQ ID NO: 19179 - DNA, 60 bp, Artificial Sequence
  Description of Artificial Sequence: Synthetic probe
acttcaccagataagggatgcgtggataaccgattcgtacaacccacgacacatacgatc

SEQ ID NO: 19180 - DNA, 60 bp, Artificial Sequence
  Description of Artificial Sequence: Synthetic probe
gacggacttacaaggttgcgtgtacaagggcgaattcctgagttaatacgaaatgagata

SEQ ID NO: 19181 - DNA, 60 bp, Artificial Sequence
  Description of Artificial Sequence: Synthetic probe
gctcgacataatcgtgcattcagagagggcatcgacggatgttccattcgaactagtcgg

SEQ ID NO: 19182 - DNA, 60 bp, Artificial Sequence
  Description of Artificial Sequence: Synthetic probe
acatgagatgatgcatagtgcgcaggagccagcatacattctgaaacccacgctcgacat

SEQ ID NO: 19183 - DNA, 60 bp, Artificial Sequence
  Description of Artificial Sequence: Synthetic probe
gggcgtgtgaccacgcgcgtgtagcaatgtggaacaatcttgtgagacatgagatgatgc

SEQ ID NO: 19184 - DNA, 60 bp, Artificial Sequence
  Description of Artificial Sequence: Synthetic probe
ccgagattcggtggatgtgcagcctctaaaagcgagcttagaatttccgtcaaagattaa

SEQ ID NO: 19185 - DNA, 60 bp, Artificial Sequence
  Description of Artificial Sequence: Synthetic probe
cgttgtggatatatcattgagcgggtacgatagacgaaaataccatcggactagcacagg

SEQ ID NO: 19186 - DNA, 60 bp, Artificial Sequence
  Description of Artificial Sequence: Synthetic probe
gccaatacgcgaagctctgaactacttacccaagaggaacaatggccacgtattaacacg

SEQ ID NO: 19187 - DNA, 60 bp, Artificial Sequence
  Description of Artificial Sequence: Synthetic probe
gtctcgtgatggatgagttagcgatacctatcattgatggtcgattcccgaaggaggcat

SEQ ID NO: 19188 - DNA, 54 bp, Artificial Sequence
  Description of Artificial Sequence: Synthetic probe
ctccatcatgcttcgaaacgcgtgagggcggatgcaggggctacttacacttac

SEQ ID NO: 19189 - DNA, 60 bp, Artificial Sequence
  Description of Artificial Sequence: Synthetic probe
cctctaacgtcgcaggacaaacagcaatccatcagcgtaggttgctaagatccagaagta

SEQ ID NO: 19190 - DNA, 60 bp, Artificial Sequence
  Description of Artificial Sequence: Synthetic probe
gataccacagacgcagaagccttcgatgcacatatatgcggctccctgggactcggatga

SEQ ID NO: 19191 - DNA, 60 bp, Artificial Sequence
  Description of Artificial Sequence: Synthetic probe
ttccgttatttggggcgggcgtagctacgagcatcgcgacggcgagggcgatagaaggcg

SEQ ID NO: 19192 - DNA, 60 bp, Artificial Sequence
  Description of Artificial Sequence: Synthetic probe
ggacgatcggaagtgcggctgaaaggtttgctgagagtgagattggcagcgcagccatcg

SEQ ID NO: 19193 - DNA, 60 bp, Artificial Sequence
  Description of Artificial Sequence: Synthetic probe
tcgcatgatggggaagatcattaaatcgctggggaagttcgggaaaaaggtaggcaatgc

SEQ ID NO: 19194 - DNA, 60 bp, Artificial Sequence
  Description of Artificial Sequence: Synthetic probe
cccagcatttcgttcagacatatcgtaatgcagtctagagatcgagttttacgagtagat

SEQ ID NO: 19195 - DNA, 60 bp, Artificial Sequence
  Description of Artificial Sequence: Synthetic probe
gggactagcacaagaagcgagcgggcgtacgttaacggaggcgtatcgtgaatttctcaa

SEQ ID NO: 19196 - DNA, 60 bp, Artificial Sequence
  Description of Artificial Sequence: Synthetic probe
aacaatcgtataatgatgcggtgaggatgagttttacggaattttcatcagtcccgctag

SEQ ID NO: 19197 - DNA, 60 bp, Artificial Sequence
  Description of Artificial Sequence: Synthetic probe
cgctggaagaagaagcttgggctgcggcgaatgattttgaggatttgatgctgactgatc

SEQ ID NO: 19198 - DNA, 60 bp, Artificial Sequence
  Description of Artificial Sequence: Synthetic probe
gcgctggaagaagaagcttgggctgcggcgaatgattttgaggatttgatgctgactgat

SEQ ID NO: 19199 - DNA, 60 bp, Artificial Sequence
  Description of Artificial Sequence: Synthetic probe
actgtgagtgtgggtggtgtggatatgagagcggggcgcataatcgcatgggatgggcag

SEQ ID NO: 19200 - DNA, 60 bp, Artificial Sequence
  Description of Artificial Sequence: Synthetic probe
gtggcattgattcgcgtgagttgatcaatccaacaacatatggcattgggatgacttatc

SEQ ID NO: 19201 - DNA, 60 bp, Artificial Sequence
  Description of Artificial Sequence: Synthetic probe
tgaaggttacacgttggaacaaatcatagattttggatatggagaagggagggttgcaaa

SEQ ID NO: 19202 - DNA, 60 bp, Artificial Sequence
  Description of Artificial Sequence: Synthetic probe
ggtacggttcatacgcggaaaaggatcctttatattgcatgatattccgaccagagatca

SEQ ID NO: 19203 - DNA, 60 bp, Artificial Sequence
  Description of Artificial Sequence: Synthetic probe
gatgtggggtgtcggagcagatccaatcattgtcttacaatctacggcgggtgatgatag

SEQ ID NO: 19204 - DNA, 60 bp, Artificial Sequence
  Description of Artificial Sequence: Synthetic probe
tgatgcggtgaggatgagttttacggaattttcgtcagtcccgctagatggtttcgaatt

SEQ ID NO: 19205 - DNA, 60 bp, Artificial Sequence
  Description of Artificial Sequence: Synthetic probe
cggggcgcataatcgcgtgggatgggcaggcggtgctacaaattcacaatccaactcagc

SEQ ID NO: 19206 - DNA, 60 bp, Artificial Sequence
  Description of Artificial Sequence: Synthetic probe
ggcactaagctggctgcgccgactgtgtagagatgcgacctatctatgcactcggtagcg

SEQ ID NO: 19207 - DNA, 60 bp, Artificial Sequence
  Description of Artificial Sequence: Synthetic probe
gcaatcgctcaaaatgggcactaagctggctgcgccgactgtgtagagatgcgacctatc

SEQ ID NO: 19208 - DNA, 60 bp, Artificial Sequence
  Description of Artificial Sequence: Synthetic probe
caatcgctcaaaatgggcactaagctggctgcgccgactgtgtagagatgcgacctatct

SEQ ID NO: 19209 - DNA, 60 bp, Artificial Sequence
  Description of Artificial Sequence: Synthetic probe
acagtcgctcaaaatgggcactaagctggctgcgccgactgtgtagagatgcgacctatc

SEQ ID NO: 19210 - DNA, 60 bp, Artificial Sequence
  Description of Artificial Sequence: Synthetic probe
acaatcgctcaaaatgggcactaagctggctgcgccgactgtgtagagatgcgacctatc

SEQ ID NO: 19211 - DNA, 60 bp, Artificial Sequence
  Description of Artificial Sequence: Synthetic probe
acaatcgctcaaaatgggtactaagctggctgcgccgactgtgtagagatgcgacctatc

SEQ ID NO: 19212 - DNA, 60 bp, Artificial Sequence
  Description of Artificial Sequence: Synthetic probe
cacacaatcgctcaaaatgggcacgaagctggctgcgccgactgtgtagagatgcgacct

SEQ ID NO: 19213 - DNA, 60 bp, Artificial Sequence
  Description of Artificial Sequence: Synthetic probe
tgcttttcacggcgggaggaagatttactaacctaactcaaaatatggctcgtcagttgg

SEQ ID NO: 19214 - DNA, 60 bp, Artificial Sequence
  Description of Artificial Sequence: Synthetic probe
ctgtgatgcgagcatgtgctacgcttcaagaagcaagaattgtgttggaagctaacgtga

SEQ ID NO: 19215 - DNA, 60 bp, Artificial Sequence
  Description of Artificial Sequence: Synthetic probe
cagatataatggattaactttacgaggggtgacgatgcgcccgacctcattggcgcagag

SEQ ID NO: 19216 - DNA, 60 bp, Artificial Sequence
  Description of Artificial Sequence: Synthetic probe
tataatgatgcggtgaggatgagtttcacagagttctcgtcagtcccgctagatggtttc

SEQ ID NO: 19217 - DNA, 60 bp, Artificial Sequence
  Description of Artificial Sequence: Synthetic probe
gaaaatacaacatcagtggggattacgcaaatgccacgaggacttttttggctatttcac

SEQ ID NO: 19218 - DNA, 60 bp, Artificial Sequence
  Description of Artificial Sequence: Synthetic probe
ggttattcacacgtagatcgtcacatgcatccagacgcctccgtgatgaaagttgtttcg

SEQ ID NO: 19219 - DNA, 60 bp, Artificial Sequence
  Description of Artificial Sequence: Synthetic probe
tgtcgtcagatcgatcgcagatggatgatgatgagtgggagtcgaccagattcgcagagg

SEQ ID NO: 19220 - DNA, 60 bp, Artificial Sequence
  Description of Artificial Sequence: Synthetic probe
tttagcgctaatgtttcctggacagattgtacttgatctaaaaattgatcctggtgagag

SEQ ID NO: 19221 - DNA, 60 bp, Artificial Sequence
  Description of Artificial Sequence: Synthetic probe
ctgacggaagagattgctcgcgcgatcgaatctaaatacggtacgaagattgatgtttac

SEQ ID NO: 19222 - DNA, 60 bp, Artificial Sequence
  Description of Artificial Sequence: Synthetic probe
ttaaaattggaagagtaatagcttttaaacctgtcaagaatccggaacctaagggatacg

SEQ ID NO: 19223 - DNA, 60 bp, Artificial Sequence
  Description of Artificial Sequence: Synthetic probe
tcataatgatggtttgtgcgaagagtgaaagagggctaaatcagcaaattgacatgatta

SEQ ID NO: 19224 - DNA, 60 bp, Artificial Sequence
  Description of Artificial Sequence: Synthetic probe
cggcgggaggacgatttactaacctaactcaaaatatggctcgtcagttggatattgcgc

SEQ ID NO: 19225 - DNA, 60 bp, Artificial Sequence
  Description of Artificial Sequence: Synthetic probe
ggtatgagttacagtgtgtgggtgcgtgtgagcgtgttgcttttgtctctaaggacatga

SEQ ID NO: 19226 - DNA, 51 bp, Artificial Sequence
  Description of Artificial Sequence: Synthetic probe
gtgcagggtggttgacctcgcggcgtaaactcccactgctgtataacgggg

SEQ ID NO: 19227 - DNA, 60 bp, Artificial Sequence
  Description of Artificial Sequence: Synthetic probe
acaagtcgtgttttacatttccatggataagactttaaatcaataccccgccttgactgc

SEQ ID NO: 19228 - DNA, 60 bp, Artificial Sequence
  Description of Artificial Sequence: Synthetic probe
accaagctggctgcgccaactgtgtaggtgcgcgaccaatctatgcacttggtagcggca

SEQ ID NO: 19229 - DNA, 60 bp, Artificial Sequence
  Description of Artificial Sequence: Synthetic probe
agcctacacgagcacgggagggaatgtaaaaacggagttcctgcatttgatcgatcacct

SEQ ID NO: 19230 - DNA, 60 bp, Artificial Sequence
  Description of Artificial Sequence: Synthetic probe
agcttacacgagcacgggaggggatgtaaaaacggagttcctgcatttgatcgatcacct

SEQ ID NO: 19231 - DNA, 60 bp, Artificial Sequence
  Description of Artificial Sequence: Synthetic probe
gcaactgctcgaggattaccgcaaaagtgggatgatggatgaggccgtgaagcaatccgc

SEQ ID NO: 19232 - DNA, 60 bp, Artificial Sequence
  Description of Artificial Sequence: Synthetic probe
aacgggtgctacgcaaacacaaaaagcggagaaggctgcattcgcatcgtacgcggaagc

SEQ ID NO: 19233 - DNA, 60 bp, Artificial Sequence
  Description of Artificial Sequence: Synthetic probe
ttacaacggaagcggcgaatgagattgctcgcgtgactggggagacttcgacgtggggac

SEQ ID NO: 19234 - DNA, 60 bp, Artificial Sequence
  Description of Artificial Sequence: Synthetic probe
gtgctagcaacgccagagatccctttcacgacggaggctgcgaatgagatcgcgcgtgta

SEQ ID NO: 19235 - DNA, 60 bp, Artificial Sequence
  Description of Artificial Sequence: Synthetic probe
gttaaaaaactatagagatggacactatctcggcaagagcacttactgtaatgcgggcat

SEQ ID NO: 19236 - DNA, 60 bp, Artificial Sequence
  Description of Artificial Sequence: Synthetic probe
gctagggatttcgcgtgagggagtggccgagcagacagagagattgagagatctgcgacg

SEQ ID NO: 19237 - DNA, 60 bp, Artificial Sequence
  Description of Artificial Sequence: Synthetic probe
gcgtacatactgcagtgggacctggatcaagcgcaaaaggacctggagaacgcgcgaacg

SEQ ID NO: 19238 - DNA, 60 bp, Artificial Sequence
  Description of Artificial Sequence: Synthetic probe
aaccgtattgtcagattaaaattggaagaataatagcttttaaacctgtcaagaatccgg

SEQ ID NO: 19239 - DNA, 60 bp, Artificial Sequence
  Description of Artificial Sequence: Synthetic probe
ccatggcatgtgagaaatgatctgatcgctgcgctaagggaatacaaacggaaaatgggg

SEQ ID NO: 19240 - DNA, 57 bp, Artificial Sequence
  Description of Artificial Sequence: Synthetic probe
ttacgaaactcttaaatatataatcccgtgactgggattgggcacgtttacacttac

SEQ ID NO: 19241 - DNA, 60 bp, Artificial Sequence
  Description of Artificial Sequence: Synthetic probe
cggttctatgtgctgatggtgatagccgcttcagacacaaacaatagtagggtttggtgg

SEQ ID NO: 19242 - DNA, 58 bp, Artificial Sequence
  Description of Artificial Sequence: Synthetic probe
agtggattgaaaaagaagcgagcaatcatacgtaccactctattggtagcagctgtgg

SEQ ID NO: 19243 - DNA, 60 bp, Artificial Sequence
  Description of Artificial Sequence: Synthetic probe
gagcggggcgcataatcgcatgggatgggcaggcggtgctacaaattcacaatccgactc

SEQ ID NO: 19244 - DNA, 60 bp, Artificial Sequence
  Description of Artificial Sequence: Synthetic probe
gaagataaagtgattcatccgcgggtgatgatgaggttcaaaattcctagaacgcagcaa

SEQ ID NO: 19245 - DNA, 60 bp, Artificial Sequence
  Description of Artificial Sequence: Synthetic probe
gcggcagttgtcgctctgttgacatcggcttgcacgttgtcgagtgatatgagcgtggca

SEQ ID NO: 19246 - DNA, 60 bp, Artificial Sequence
  Description of Artificial Sequence: Synthetic probe
caagaacacgtaaatatatttaaagtaggtggttccgcaacagatgatgggagattttac

SEQ ID NO: 19247 - DNA, 60 bp, Artificial Sequence
  Description of Artificial Sequence: Synthetic probe
tgcattcgcatcgtacgcagaagcgtttcgtgatgatgtgagattgaggcagattaaacg

SEQ ID NO: 19248 - DNA, 60 bp, Artificial Sequence
  Description of Artificial Sequence: Synthetic probe
aacctattatatatacgatagattggttccgaacaagcgcctatgaatacgtcgacgtct

SEQ ID NO: 19249 - DNA, 60 bp, Artificial Sequence
  Description of Artificial Sequence: Synthetic probe
tcgatggcgatacagcaatatttgagagttggttatgctgaagagatcaggtatgtgcaa

SEQ ID NO: 19250 - DNA, 60 bp, Artificial Sequence
  Description of Artificial Sequence: Synthetic probe
cttcgatggcgatacagcaatatttgagagttggttatgctgaagagatcaggtatgtgc

SEQ ID NO: 19251 - DNA, 60 bp, Artificial Sequence
  Description of Artificial Sequence: Synthetic probe
tgcattcgcatcgtacgcagaagcgtttcgtgatgatgtgaggctgagacaaattaaacg

SEQ ID NO: 19252 - DNA, 60 bp, Artificial Sequence
  Description of Artificial Sequence: Synthetic probe
cagtcccgctagatggtttcgaattaccattaacctaagatcagtaggtagagtggcgcc

SEQ ID NO: 19253 - DNA, 60 bp, Artificial Sequence
  Description of Artificial Sequence: Synthetic probe
gtgctcccaagttatttcgatcaatggatctactcgccgatgtttaatgcgcgactgcga

SEQ ID NO: 19254 - DNA, 60 bp, Artificial Sequence
  Description of Artificial Sequence: Synthetic probe
tactcgcagaagatggggaagataattaaatcgctaagtagatttgggaagaaggttgga

SEQ ID NO: 19255 - DNA, 60 bp, Artificial Sequence
  Description of Artificial Sequence: Synthetic probe
ctgatgcgggagttggaactactggaacgaatggaggaggatgggtagttctaacggaag

SEQ ID NO: 19256 - DNA, 60 bp, Artificial Sequence
  Description of Artificial Sequence: Synthetic probe
gcttatcaagttactgaacgtttagtctcagtgacatgagactcctggagcttacactta

SEQ ID NO: 19257 - DNA, 56 bp, Artificial Sequence
  Description of Artificial Sequence: Synthetic probe
cggggatgtatctactttctctcgtggtattgtgcatgccgagttactgaaaaaga

SEQ ID NO: 19258 - DNA, 60 bp, Artificial Sequence
  Description of Artificial Sequence: Synthetic probe
cacgttagtgagcatgttcgaggcgtcgtagcgatttcgatctcgagaaacggggatgta

SEQ ID NO: 19259 - DNA, 60 bp, Artificial Sequence
  Description of Artificial Sequence: Synthetic probe
cgtcgttatgtggaggactgtcggatgcgatagtttatgcattgccaatcagttttccga

SEQ ID NO: 19260 - DNA, 59 bp, Artificial Sequence
  Description of Artificial Sequence: Synthetic probe
gctcacagatagcgatagcggaggcgtacagaagaacgtgcgtgtcacgaagtcggcgc

SEQ ID NO: 19261 - DNA, 60 bp, Artificial Sequence
  Description of Artificial Sequence: Synthetic probe
ggcctgcgcaggtaggagctaattataatagatttggattctacggttttctcaactata

SEQ ID NO: 19262 - DNA, 60 bp, Artificial Sequence
  Description of Artificial Sequence: Synthetic probe
atagggagtgggtggttccaattctcatatatgcggatggcgtgatgatctggcctgcgc

SEQ ID NO: 19263 - DNA, 60 bp, Artificial Sequence
  Description of Artificial Sequence: Synthetic probe
cgcttacgggcggactcttcgtgccgttgaaagcgctactgatgtagggcaaatcaccgc

SEQ ID NO: 19264 - DNA, 60 bp, Artificial Sequence
  Description of Artificial Sequence: Synthetic probe
caggcgggtggtacgtccgcgtgaggaggcgaggtacatgatccatcaaatacgagagtc

SEQ ID NO: 19265 - DNA, 60 bp, Artificial Sequence
  Description of Artificial Sequence: Synthetic probe
gatgatttaccatgttgaacatgattgggaaccactgaaacagtacacgcacccaagtgt

SEQ ID NO: 19266 - DNA, 60 bp, Artificial Sequence
  Description of Artificial Sequence: Synthetic probe
cttgctcagttcattatacttcctccttcatactgcaaaaaatctctgagttgactctaa

SEQ ID NO: 19267 - DNA, 60 bp, Artificial Sequence
  Description of Artificial Sequence: Synthetic probe
tacacgtcccgccgtaatgggtcgaacattgtcggcacgccagaatcagacggcattgca

SEQ ID NO: 19268 - DNA, 60 bp, Artificial Sequence
  Description of Artificial Sequence: Synthetic probe
gatgttgcagttgagagtggtagggcatctatatgatacacgtcccgccgtaatgggtcg

SEQ ID NO: 19269 - DNA, 60 bp, Artificial Sequence
  Description of Artificial Sequence: Synthetic probe
tctgatgatccggtgatgttgcagttgagagtggtagggcatctatatgatacacgtccc

SEQ ID NO: 19270 - DNA, 60 bp, Artificial Sequence
  Description of Artificial Sequence: Synthetic probe
gcgcaatctgaagttgagtacccttactattatgatacgtggatttacgcgccgatcttc

SEQ ID NO: 19271 - DNA, 60 bp, Artificial Sequence
  Description of Artificial Sequence: Synthetic probe
tagatgatgggcagtatagagatttggtttcaagagtgataaacggtggatgggatcagg

SEQ ID NO: 19272 - DNA, 60 bp, Artificial Sequence
  Description of Artificial Sequence: Synthetic probe
aacaacatgggcggaggggtgtcccttcaaagatgaagcgccggatgatgatctacactg

SEQ ID NO: 19273 - DNA, 60 bp, Artificial Sequence
  Description of Artificial Sequence: Synthetic probe
cttcctatgtgtttacgagaatcaatctatttgacacagataaaacaccgggctctcgtg

SEQ ID NO: 19274 - DNA, 60 bp, Artificial Sequence
  Description of Artificial Sequence: Synthetic probe
ctcgaatccatacccatgtttacgcggtactctaattgcggcggagtgcgtgttagggga

SEQ ID NO: 19275 - DNA, 60 bp, Artificial Sequence
  Description of Artificial Sequence: Synthetic probe
gcggaaggactgatgatgaaagattctacgctttattgctaatttgtgccactgacgcat

SEQ ID NO: 19276 - DNA, 58 bp, Artificial Sequence
  Description of Artificial Sequence: Synthetic probe
cctaaagacgaaggggtcatgtcgttaaaatttcaagggaaaattgatgcgatgtttt

SEQ ID NO: 19277 - DNA, 60 bp, Artificial Sequence
  Description of Artificial Sequence: Synthetic probe
ccctagctatccgctgtttcgcgccggattgttacagataatcgttaacggaactacgcc

SEQ ID NO: 19278 - DNA, 55 bp, Artificial Sequence
  Description of Artificial Sequence: Synthetic probe
aaaattgggagcctagggagaagagcaagagttgacatgactgaccctagctatc

SEQ ID NO: 19279 - DNA, 60 bp, Artificial Sequence
  Description of Artificial Sequence: Synthetic probe
taatgtacaccatctaattaattgtggaatgtataacgtggagcaagagtgcgcattcgc

SEQ ID NO: 19280 - DNA, 60 bp, Artificial Sequence
  Description of Artificial Sequence: Synthetic probe
gtggtgtcacgttttatacggatcataaatggatggagtggatgttatctgacgcgatgg

SEQ ID NO: 19281 - DNA, 60 bp, Artificial Sequence
  Description of Artificial Sequence: Synthetic probe
cccaacggataacgaggggaaccaattgccacgagctttggatatcgctctttgcgcgcg

SEQ ID NO: 19282 - DNA, 60 bp, Artificial Sequence
  Description of Artificial Sequence: Synthetic probe
ggaagacaatcgatataccggatggtgaagtaaggtctgacttaaactataacccaacgg

SEQ ID NO: 19283 - DNA, 60 bp, Artificial Sequence
  Description of Artificial Sequence: Synthetic probe
gagtgacagggtagtgcagaatgatggtcgtcatgatccacggaaattaaaggaacggaa

SEQ ID NO: 19284 - DNA, 60 bp, Artificial Sequence
  Description of Artificial Sequence: Synthetic probe
ccgcatcatatattagaggggtacgatgttaagatcgatttgagtgacagggtagtgcag

SEQ ID NO: 19285 - DNA, 60 bp, Artificial Sequence
  Description of Artificial Sequence: Synthetic probe
gcttctcaggatggatgagttcggtatcccgattttgcgatcgagccaagttccgcatca

SEQ ID NO: 19286 - DNA, 60 bp, Artificial Sequence
  Description of Artificial Sequence: Synthetic probe
agcctagtatttatgaggtaatgaagaagtcggtgatagctactgcttgggtgggccgtg

SEQ ID NO: 19287 - DNA, 60 bp, Artificial Sequence
  Description of Artificial Sequence: Synthetic probe
cggcccacccaagcagtagctatcaccgacttcttcattacctcataaatactaggctcc

SEQ ID NO: 19288 - DNA, 60 bp, Artificial Sequence
  Description of Artificial Sequence: Synthetic probe
cgatcaccaggacggtttagaagagtgttatggcacgtatatgacccaatagcacctgag

SEQ ID NO: 19289 - DNA, 60 bp, Artificial Sequence
  Description of Artificial Sequence: Synthetic probe
acgatcaccaggacggtttagaagagtgttatggcacgtatatgacccaatagcacctga

SEQ ID NO: 19290 - DNA, 60 bp, Artificial Sequence
  Description of Artificial Sequence: Synthetic probe
cgcattattacccgacttaattgctggggcgcatcagaacgccgacccagtcgtgctaga

SEQ ID NO: 19291 - DNA, 60 bp, Artificial Sequence
  Description of Artificial Sequence: Synthetic probe
tacaggagattgcggggatgaccgcagatgtgttagaggcggcatcggaggaggttccgc

SEQ ID NO: 19292 - DNA, 60 bp, Artificial Sequence
  Description of Artificial Sequence: Synthetic probe
tactggaacaggatataatggttgggcgacgattgatgttgagtatagagaacccgcgcc

SEQ ID NO: 19293 - DNA, 60 bp, Artificial Sequence
  Description of Artificial Sequence: Synthetic probe
tcgagcggattttgctactggaacaggatataatggttgggcgacgattgatgttgagta

SEQ ID NO: 19294 - DNA, 60 bp, Artificial Sequence
  Description of Artificial Sequence: Synthetic probe
gatgatgtaagattgagacaaattaaacgccatgtaaatgagcagattctacccaaattg

SEQ ID NO: 19295 - DNA, 60 bp, Artificial Sequence
  Description of Artificial Sequence: Synthetic probe
gttaaaatagtagcgcgatggatgagctaggcatcccagtttataagagaggatttcccg

SEQ ID NO: 19296 - DNA, 60 bp, Artificial Sequence
  Description of Artificial Sequence: Synthetic probe
aatgagatgttttttatgtgtcttgatatgatgttgtctgctgcgggaataaatgttgga

SEQ ID NO: 19297 - DNA, 60 bp, Artificial Sequence
  Description of Artificial Sequence: Synthetic probe
ctggctgcgccaactgtgtagatgcgcgaccaatctatgcacttggtagcggcagcggaa

SEQ ID NO: 19298 - DNA, 60 bp, Artificial Sequence
  Description of Artificial Sequence: Synthetic probe
cgtgtatcggtggagcttgcggccggaatacggtcaacgggaacggcaattggaggacaa

SEQ ID NO: 19299 - DNA, 60 bp, Artificial Sequence
  Description of Artificial Sequence: Synthetic probe
cacgtgtatcgatggagcttgcggccggaatacggtcaacgggaacggcaattggaggac

SEQ ID NO: 19300 - DNA, 60 bp, Artificial Sequence
  Description of Artificial Sequence: Synthetic probe
aagattccaagccaagatggccgacatgacgtatctaagattccagagatgtacgcattc

SEQ ID NO: 19301 - DNA, 59 bp, Artificial Sequence
  Description of Artificial Sequence: Synthetic probe
ttttctacgctaacggattatacgaaaggaagaacagtgtgccctcactcaggcgggac

SEQ ID NO: 19302 - DNA, 60 bp, Artificial Sequence
  Description of Artificial Sequence: Synthetic probe
tttctctacgctaacggattatacgaaaggaagaacagtgtgccctcactcaggcgggac

SEQ ID NO: 19303 - DNA, 60 bp, Artificial Sequence
  Description of Artificial Sequence: Synthetic probe
gccacggcttcaagttcagagcgtggcgtcaagggaggagtcgcgctggatggatgatga

SEQ ID NO: 19304 - DNA, 60 bp, Artificial Sequence
  Description of Artificial Sequence: Synthetic probe
gcgacatctttcgttgatgcagaggagattcccagatgttttaatccaagcgagaccgtc

SEQ ID NO: 19305 - DNA, 60 bp, Artificial Sequence
  Description of Artificial Sequence: Synthetic probe
ggctgagcagacggagagattgagagatctgcggcgaaaagagaagagtggggcgcatgc

SEQ ID NO: 19306 - DNA, 60 bp, Artificial Sequence
  Description of Artificial Sequence: Synthetic probe
actggtagctgccgtggttgcgctattaacatcagtttgcaccctttcaagcgatatgag

SEQ ID NO: 19307 - DNA, 60 bp, Artificial Sequence
  Description of Artificial Sequence: Synthetic probe
acccgaaagttatgatgaaatttaagattccgagagcacagcaaccacatattcatattt

SEQ ID NO: 19308 - DNA, 60 bp, Artificial Sequence
  Description of Artificial Sequence: Synthetic probe
ccgatgttgggtgtggtgaatctgggggctacctttctgatgatggtttgcgcaaaaagt

SEQ ID NO: 19309 - DNA, 60 bp, Artificial Sequence
  Description of Artificial Sequence: Synthetic probe
cagccattggcacgcattgggactagcgcaagaggcgagcgggcgtacgttaacggaggc

SEQ ID NO: 19310 - DNA, 60 bp, Artificial Sequence
  Description of Artificial Sequence: Synthetic probe
agtcattggcacgcattgggattagcgcaagaggcgagcgggcgtacgttaacggaggcg

SEQ ID NO: 19311 - DNA, 60 bp, Artificial Sequence
  Description of Artificial Sequence: Synthetic probe
cagccattggcacgcattagggttagcgcaagaggcgagcgggcgtacgttaacggaggc

SEQ ID NO: 19312 - DNA, 60 bp, Artificial Sequence
  Description of Artificial Sequence: Synthetic probe
cccactttgcacgggtgtgggttgcacaaacggtgtgtcggttgtgggaggtgtaaccca

SEQ ID NO: 19313 - DNA, 63 bp, Artificial Sequence
  Description of Artificial Sequence: Synthetic probe
gcgtttcgtgatgatgtaagattaagacaaattaaacgccatgtaaatgaacagattttaccc

SEQ ID NO: 19314 - DNA, 60 bp, Artificial Sequence
  Description of Artificial Sequence: Synthetic probe
cgaaaaggtatgagttacagtgtgtgggtgcgtgtgagcgtgttgcttttgtctctaagg

SEQ ID NO: 19315 - DNA, 60 bp, Artificial Sequence
  Description of Artificial Sequence: Synthetic probe
taacggaggcgtatcgtgaatttctcaatctatcaatttcaagcacgtatagtagtgcga

SEQ ID NO: 19316 - DNA, 60 bp, Artificial Sequence
  Description of Artificial Sequence: Synthetic probe
ccactttgcacgggtgtgggttgcacaaacggtgtgtcggttgtgggaggtgtaacccat

SEQ ID NO: 19317 - DNA, 60 bp, Artificial Sequence
  Description of Artificial Sequence: Synthetic probe
taagattgaccctggtgaaaggatggatccagcagtaagaatggtcgcgggcgttgtggg

SEQ ID NO: 19318 - DNA, 60 bp, Artificial Sequence
  Description of Artificial Sequence: Synthetic probe
ctgagttctcgtcagtcccgcttgatggtttcgagttaccattaacctaagatcagtagg

SEQ ID NO: 19319 - DNA, 60 bp, Artificial Sequence
  Description of Artificial Sequence: Synthetic probe
gcgatgtcaatacaacgggtgctacgcaacacaaaaagcggagaaggctgcattcgcatc

SEQ ID NO: 19320 - DNA, 60 bp, Artificial Sequence
  Description of Artificial Sequence: Synthetic probe
ccgatatctccagattatacccaacatatggctacaattggtgtgctagcgacgccagag

SEQ ID NO: 19321 - DNA, 60 bp, Artificial Sequence
  Description of Artificial Sequence: Synthetic probe
ggaataaacgtaggaccgatatctccagattatacccaacatatggctacaattggtgtg

SEQ ID NO: 19322 - DNA, 60 bp, Artificial Sequence
  Description of Artificial Sequence: Synthetic probe
acatcagtggggattacgcaaatgccacgaggacttttttggctatctcaccacaatgga

SEQ ID NO: 19323 - DNA, 60 bp, Artificial Sequence
  Description of Artificial Sequence: Synthetic probe
ccaggacaaatcatacttgatcttaagattgaccctggtgaaaggatggatccagcagta

SEQ ID NO: 19324 - DNA, 60 bp, Artificial Sequence
  Description of Artificial Sequence: Synthetic probe
cggcatgtaaatgaacaaattctaccaaaattgaaaagcgacctaggaggcctaaagaag

SEQ ID NO: 19325 - DNA, 60 bp, Artificial Sequence
  Description of Artificial Sequence: Synthetic probe
ttaaacggcatgtaaatgaacaaattctaccaaaattgaaaagcgacctaggaggcctaa

SEQ ID NO: 19326 - DNA, 55 bp, Artificial Sequence
  Description of Artificial Sequence: Synthetic probe
atggatgaacttggcattccgatttatggacgtaactacccagagcatttattaa

SEQ ID NO: 19327 - DNA, 60 bp, Artificial Sequence
  Description of Artificial Sequence: Synthetic probe
gcactgaattcgataaacagctgaagccgaacccaagcaatctggttcgggatgtttcgg

SEQ ID NO: 19328 - DNA, 60 bp, Artificial Sequence
  Description of Artificial Sequence: Synthetic probe
gcactgaattcgataaacagctgaagccgaacccgagcaatctggttcaggacgtttcgg

SEQ ID NO: 19329 - DNA, 60 bp, Artificial Sequence
  Description of Artificial Sequence: Synthetic probe
agcactgaattcgataaacagctgaagccgaacccgagcaatctggttcaggatgtttcg

SEQ ID NO: 19330 - DNA, 58 bp, Artificial Sequence
  Description of Artificial Sequence: Synthetic probe
ggtttatactacaccattttatccgcataagagctcgaacatgatactggcgtctttt

SEQ ID NO: 19331 - DNA, 60 bp, Artificial Sequence
  Description of Artificial Sequence: Synthetic probe
ccgagccaaaccgatacaaagctctatttcggtcatcgttttataacgaatcaagacgaa

SEQ ID NO: 19332 - DNA, 58 bp, Artificial Sequence
  Description of Artificial Sequence: Synthetic probe
accgagccaaaccgatacaaagctctatttcggtcatcattttataacgaatcaagac

SEQ ID NO: 19333 - DNA, 53 bp, Artificial Sequence
  Description of Artificial Sequence: Synthetic probe
cattcttttctatctattttctcttagcactctactagaacttttcaacttac

SEQ ID NO: 19334 - DNA, 60 bp, Artificial Sequence
  Description of Artificial Sequence: Synthetic probe
gcgcaacgcagcgcactgcttagactcttttgcttcgtatgttacggatatgcgccacgc

SEQ ID NO: 19335 - DNA, 60 bp, Artificial Sequence
  Description of Artificial Sequence: Synthetic probe
tgggagttaacgaaggcgcaacgcagcgcactgcttagactcttttgcttcgtatgttac

SEQ ID NO: 19336 - DNA, 60 bp, Artificial Sequence
  Description of Artificial Sequence: Synthetic probe
ggcgctgaagcattggtcacgactgctattcacatgcatcgatggataagagggtgtggc

SEQ ID NO: 19337 - DNA, 60 bp, Artificial Sequence
  Description of Artificial Sequence: Synthetic probe
ggtgtgatcgatgtgcgtgcatcggaattggttgggtgttcaccctttagaacggttaag

SEQ ID NO: 19338 - DNA, 60 bp, Artificial Sequence
  Description of Artificial Sequence: Synthetic probe
gctatgctatctaaaacattcaaagcagacacaaacatgtggtgtgatcgatgtgcgtgc

SEQ ID NO: 19339 - DNA, 60 bp, Artificial Sequence
  Description of Artificial Sequence: Synthetic probe
gagttcccattgcatcagatgatgttgatgagacgtgatttccccacgcgcgaccgcagc

SEQ ID NO: 19340 - DNA, 60 bp, Artificial Sequence
  Description of Artificial Sequence: Synthetic probe
ttggctatgctgaagaagtcaggtatgtgcaacaattgtttgggaaagttccaactggtg

SEQ ID NO: 19341 - DNA, 60 bp, Artificial Sequence
  Description of Artificial Sequence: Synthetic probe
gatgctgcggatgattggatcgatccaaatttgttcgggatccgggggcaacacaatcag

SEQ ID NO: 19342 - DNA, 58 bp, Artificial Sequence
  Description of Artificial Sequence: Synthetic probe
ggctaaagaggcgatgtatgatcgagaaacggtttggctccaatgcttcaaaagtttt

SEQ ID NO: 19343 - DNA, 60 bp, Artificial Sequence
  Description of Artificial Sequence: Synthetic probe
gtgttaggtgataaagttgatgttccgctcttcctaaaaaacgcgtgacagcggtgatcc

SEQ ID NO: 19344 - DNA, 60 bp, Artificial Sequence
  Description of Artificial Sequence: Synthetic probe
catccgagagtgatgatgagatttaaggtgcctagatcacaacagccgcaaattcacata

SEQ ID NO: 19345 - DNA, 60 bp, Artificial Sequence
  Description of Artificial Sequence: Synthetic probe
gatgttctggaggcggcttcggaagaagttcctctagtaggatcgggaatggcaacggct

SEQ ID NO: 19346 - DNA, 60 bp, Artificial Sequence
  Description of Artificial Sequence: Synthetic probe
gattcatatgaaaacctactcgtcacagagaatgagcaaatgcgtacgttggcgcgcgcg

SEQ ID NO: 19347 - DNA, 60 bp, Artificial Sequence
  Description of Artificial Sequence: Synthetic probe
ggcgcaggagatgagatcccggacccacttagtcctggagagcgtggcatccagacaaaa

SEQ ID NO: 19348 - DNA, 60 bp, Artificial Sequence
  Description of Artificial Sequence: Synthetic probe
acaatcgggaaggcagcggagcgttttgctgaaagtgagattggttcggccgcgattgat

SEQ ID NO: 19349 - DNA, 60 bp, Artificial Sequence
  Description of Artificial Sequence: Synthetic probe
catcccaactagagatcatcgcgggatggaggttgcggaaccagaggtattaggcgtgga

SEQ ID NO: 19350 - DNA, 60 bp, Artificial Sequence
  Description of Artificial Sequence: Synthetic probe
tgactaaagttttcattaataagagaattgttgagcgagtacgggttggacagattctgg

SEQ ID NO: 19351 - DNA, 60 bp, Artificial Sequence
  Description of Artificial Sequence: Synthetic probe
cgcatcgtacgcagaagcgtttcgtgatgatgtgagattgaggcagattaaacgacatgt

SEQ ID NO: 19352 - DNA, 60 bp, Artificial Sequence
  Description of Artificial Sequence: Synthetic probe
gaaaatacaacatcagtggggattatgctaatgccacgagaacttttttggctatatcac

SEQ ID NO: 19353 - DNA, 60 bp, Artificial Sequence
  Description of Artificial Sequence: Synthetic probe
caggaacgcagatgcatacgaaaaggttggtgagatcgaaaacggtacaccccatctatc

SEQ ID NO: 19354 - DNA, 60 bp, Artificial Sequence
  Description of Artificial Sequence: Synthetic probe
aacagcgcattggcatgcgttaggtgcggcgcagatggctgctggacgtacgttaaccga

SEQ ID NO: 19355 - DNA, 60 bp, Artificial Sequence
  Description of Artificial Sequence: Synthetic probe
gagttcatgaatggggaagcgaaagtagaagccgaagatgagaagcaatttgatatactt

SEQ ID NO: 19356 - DNA, 60 bp, Artificial Sequence
  Description of Artificial Sequence: Synthetic probe
ggcatggattgagaactgcgattttgaatagaaccactttaccaaatatgctaccaccaa

SEQ ID NO: 19357 - DNA, 60 bp, Artificial Sequence
  Description of Artificial Sequence: Synthetic probe
cagagacagattcaaattaatttagttgattggacagaaggtgagagcggaaaagagggt

SEQ ID NO: 19358 - DNA, 60 bp, Artificial Sequence
  Description of Artificial Sequence: Synthetic probe
tccgaggagttaaaacagagacagattcaaattaatttagttgattggacagaaggtgag

SEQ ID NO: 19359 - DNA, 60 bp, Artificial Sequence
  Description of Artificial Sequence: Synthetic probe
tttagcgctaatgtttcctggacagattatacttgacctaaaaatcgatcccggcgagag

SEQ ID NO: 19360 - DNA, 60 bp, Artificial Sequence
  Description of Artificial Sequence: Synthetic probe
atgcagaaaaggttcacttcgctgggttcgtggcacctgcgtgtgagagcggggaagtta

SEQ ID NO: 19361 - DNA, 60 bp, Artificial Sequence
  Description of Artificial Sequence: Synthetic probe
ttaagacaaaattagttcgcgatgaacagattggcaggatcggagatcattattatacaa

SEQ ID NO: 19362 - DNA, 60 bp, Artificial Sequence
  Description of Artificial Sequence: Synthetic probe
gtgaggttgagaggcaaattaacacatgcccctacactggatacaaaggcagagtatttc

SEQ ID NO: 19363 - DNA, 60 bp, Artificial Sequence
  Description of Artificial Sequence: Synthetic probe
ttccgagcggatttcgcgacgggaacaggatataatggttgggcgacgattgatgtcgag

SEQ ID NO: 19364 - DNA, 60 bp, Artificial Sequence
  Description of Artificial Sequence: Synthetic probe
ccaatatcaccggattacacacagcatatggcgacgattggagtgctagcaacgccagag

SEQ ID NO: 19365 - DNA, 60 bp, Artificial Sequence
  Description of Artificial Sequence: Synthetic probe
tcgcgaagcaggttaaacttaaggatgaacgatttatgagtttgtcgagcgccatgccgc

SEQ ID NO: 19366 - DNA, 60 bp, Artificial Sequence
  Description of Artificial Sequence: Synthetic probe
gaagccgcttccagcgtaagtcggctggaggggttgcgtgaagcaagagcgaatatgttt

SEQ ID NO: 19367 - DNA, 60 bp, Artificial Sequence
  Description of Artificial Sequence: Synthetic probe
acgaagatgaggcgagggttagcgaagagatgaaagaagccgcttccagcgtaagtcggc

SEQ ID NO: 19368 - DNA, 60 bp, Artificial Sequence
  Description of Artificial Sequence: Synthetic probe
agtcgcgttggatggacgaagatgaggcgagggttagcgaagagatgaaagaagccgctt

SEQ ID NO: 19369 - DNA, 60 bp, Artificial Sequence
  Description of Artificial Sequence: Synthetic probe
cgcgcccacaggttcagagcacggtatcaagggaagagtcgcgttggatggacgaagatg

SEQ ID NO: 19370 - DNA, 60 bp, Artificial Sequence
  Description of Artificial Sequence: Synthetic probe
gcgtgagatggcaccgcgcccacaggttcagagcacggtatcaagggaagagtcgcgttg

SEQ ID NO: 19371 - DNA, 58 bp, Artificial Sequence
  Description of Artificial Sequence: Synthetic probe
tgcagggggatgggaatcgtccaaccatatatgaaaaatgatttcgatcgaaatgaaa

SEQ ID NO: 19372 - DNA, 60 bp, Artificial Sequence
  Description of Artificial Sequence: Synthetic probe
cgacacgagtacaacataatggagtgatggtagatgcggaaataaagtattgcaggggga

SEQ ID NO: 19373 - DNA, 60 bp, Artificial Sequence
  Description of Artificial Sequence: Synthetic probe
gcccaagggctatgtcttaaacgttccgggaccaggcgcctatagaatacaggacggaca

SEQ ID NO: 19374 - DNA, 60 bp, Artificial Sequence
  Description of Artificial Sequence: Synthetic probe
tcaaataaaaattggaagagtgatcgcttttaaaccagttaagaatccagagcccaaggg

SEQ ID NO: 19375 - DNA, 60 bp, Artificial Sequence
  Description of Artificial Sequence: Synthetic probe
ccatcaggctctcgtacaagatgattcgtattcaaggctattgaggcggcgcgatgtgga

SEQ ID NO: 19376 - DNA, 60 bp, Artificial Sequence
  Description of Artificial Sequence: Synthetic probe
ggtccaacccttacccgtgtttacgaggcgcgttaattgcggcggagtgcaaattgggcg

SEQ ID NO: 19377 - DNA, 60 bp, Artificial Sequence
  Description of Artificial Sequence: Synthetic probe
ctagccaagaataacgcgataacggcaaacacgagagagatccagcatattaaagaggag

SEQ ID NO: 19378 - DNA, 60 bp, Artificial Sequence
  Description of Artificial Sequence: Synthetic probe
actagccaagaataacgcgataacggcaaacacgagagagatccagcatattaaagagga

SEQ ID NO: 19379 - DNA, 60 bp, Artificial Sequence
  Description of Artificial Sequence: Synthetic probe
gatgtcgaagggaagatgaagcggtgcggggtgcaactgctcgaggattaccgcaaaagt

SEQ ID NO: 19380 - DNA, 60 bp, Artificial Sequence
  Description of Artificial Sequence: Synthetic probe
ccgcagtggtttaagagtttaaatcctatactcggagtggtaaatctaggtgcgactttc

SEQ ID NO: 19381 - DNA, 60 bp, Artificial Sequence
  Description of Artificial Sequence: Synthetic probe
gtgccatactcagtccgaagagagaggatcatttcgagattccctcttagctctaagcat

SEQ ID NO: 19382 - DNA, 60 bp, Artificial Sequence
  Description of Artificial Sequence: Synthetic probe
aggaggcatgggccgctgcaaacgattttgaggatctgatgcttactgaccaagtttata

SEQ ID NO: 19383 - DNA, 60 bp, Artificial Sequence
  Description of Artificial Sequence: Synthetic probe
gggttgaagagctgagtttagtgcgtgtggatgataccgtttctcaaccaccaaggtatg

SEQ ID NO: 19384 - DNA, 60 bp, Artificial Sequence
  Description of Artificial Sequence: Synthetic probe
ccacgcagttctattgccaaccttatcatgaatatagcgacgtgtctacctacaggagag

SEQ ID NO: 19385 - DNA, 60 bp, Artificial Sequence
  Description of Artificial Sequence: Synthetic probe
atggataagactttaaatcaataccccgccttgactgcagagatatttaacgtctatagc

SEQ ID NO: 19386 - DNA, 60 bp, Artificial Sequence
  Description of Artificial Sequence: Synthetic probe
gtgaaagagccttgaaccagcagatagatatgataaagaaagaagtgatgaaaaaacaat

SEQ ID NO: 19387 - DNA, 60 bp, Artificial Sequence
  Description of Artificial Sequence: Synthetic probe
cgtgtgagcgtgttgcttttgtctctaaggacatgagcttgatcatattgcggtcggcgt

SEQ ID NO: 19388 - DNA, 60 bp, Artificial Sequence
  Description of Artificial Sequence: Synthetic probe
ttacatggataggaaacatacatgtcaactttgctacttgaaacattcaaaacagatccc

SEQ ID NO: 19389 - DNA, 60 bp, Artificial Sequence
  Description of Artificial Sequence: Synthetic probe
atctggggattgatgttgtccactttgaggatctagccgctcactggcacgcgctcgggg

SEQ ID NO: 19390 - DNA, 60 bp, Artificial Sequence
  Description of Artificial Sequence: Synthetic probe
gaacaccgaaaatagagcccaccatgttcgcgaccaccttagaacacagatttagagata

SEQ ID NO: 19391 - DNA, 60 bp, Artificial Sequence
  Description of Artificial Sequence: Synthetic probe
gcaggaggagggaattcaagagatcgcgggtatgacagctgatgtgttagaagccgcctc

SEQ ID NO: 19392 - DNA, 60 bp, Artificial Sequence
  Description of Artificial Sequence: Synthetic probe
gcggcagttgtcgctctgttgacatcggtgtgcaccttgtcgagtgatatgagcgtggca

SEQ ID NO: 19393 - DNA, 60 bp, Artificial Sequence
  Description of Artificial Sequence: Synthetic probe
gatgtaagctggatatcactttggttcgcctttaatcggtcgtttgagccaacgcatcgt

SEQ ID NO: 19394 - DNA, 60 bp, Artificial Sequence
  Description of Artificial Sequence: Synthetic probe
gttcacccgaaccgtactttcagcgttacgacctgtgggattgtgaagcataaggtgtgt

SEQ ID NO: 19395 - DNA, 59 bp, Artificial Sequence
  Description of Artificial Sequence: Synthetic probe
aaaacgagaggagaagcttgaagaggatattgtgttgtgtgctgatgcgatcgtgaatt

SEQ ID NO: 19396 - DNA, 60 bp, Artificial Sequence
  Description of Artificial Sequence: Synthetic probe
tgcatcggcgttcgaagtggatggtacactgtacgatatctcgcagactatagttcacat

SEQ ID NO: 19397 - DNA, 60 bp, Artificial Sequence
  Description of Artificial Sequence: Synthetic probe
tccatcaggctctcgtacaagatgattcgtattcaaggctattgaggcggcgcgatgtgg

SEQ ID NO: 19398 - DNA, 60 bp, Artificial Sequence
  Description of Artificial Sequence: Synthetic probe
aagatcgaagtatgcctggggtgttcgaccaacctacaagccaaaagatctggaacgcga

SEQ ID NO: 19399 - DNA, 60 bp, Artificial Sequence
  Description of Artificial Sequence: Synthetic probe
ctgacacgaataacggtcgagtgtggtggtccaacccttacccgtgtttacgaggcgcgt

SEQ ID NO: 19400 - DNA, 60 bp, Artificial Sequence
  Description of Artificial Sequence: Synthetic probe
tcggtcaaattccaattcagattagacgaaaaattctctcccaacgatccagagcgaaac

SEQ ID NO: 19401 - DNA, 60 bp, Artificial Sequence
  Description of Artificial Sequence: Synthetic probe
caggtacgactccagctaagatacgtgatgaggtcgcagcgcttgatgttatcagagata

SEQ ID NO: 19402 - DNA, 60 bp, Artificial Sequence
  Description of Artificial Sequence: Synthetic probe
ccgagcgtaaatgttgccatgtgcgtacagaagtgtggaatagtgtagtccgcaaccacc

SEQ ID NO: 19403 - DNA, 60 bp, Artificial Sequence
  Description of Artificial Sequence: Synthetic probe
agtggacgaatcacgacgttacacagataccaggcaggcggatgtttgatgtagcgcagc

SEQ ID NO: 19404 - DNA, 60 bp, Artificial Sequence
  Description of Artificial Sequence: Synthetic probe
ggcggagaaagctgcattcgcatcgtacgcagaagcgtttcgtgatgatgtgagactaag

SEQ ID NO: 19405 - DNA, 58 bp, Artificial Sequence
  Description of Artificial Sequence: Synthetic probe
gatatctccctatgcagatttatcggactacgcgttgagtcatctgtgttgagggtcc

SEQ ID NO: 19406 - DNA, 60 bp, Artificial Sequence
  Description of Artificial Sequence: Synthetic probe
gcatcgttctaataattgtgggagacgacaaattggaaccgcatacgcgttcagaacaga

SEQ ID NO: 19407 - DNA, 60 bp, Artificial Sequence
  Description of Artificial Sequence: Synthetic probe
cagctcgatgattttcccgcgcttacgcagctaacaggagatgccgtatgcccacattca

SEQ ID NO: 19408 - DNA, 60 bp, Artificial Sequence
  Description of Artificial Sequence: Synthetic probe
agggcagagtggatagcggctacatacgatagaggcaggattagagcgctagagctatgc

SEQ ID NO: 19409 - DNA, 60 bp, Artificial Sequence
  Description of Artificial Sequence: Synthetic probe
ctaaacatttaaggggtatcgcattaatcgcggtcaatcggaatcagaaagtgtcggtgc

SEQ ID NO: 19410 - DNA, 60 bp, Artificial Sequence
  Description of Artificial Sequence: Synthetic probe
cggcgacaacatggcttacgctcatagacagtggagcatacctgtcctattatacgctca

SEQ ID NO: 19411 - DNA, 60 bp, Artificial Sequence
  Description of Artificial Sequence: Synthetic probe
gtcgtaaggagattagaagcgtgactgaagcgaggtggattttgtttaaggtcagatccg

SEQ ID NO: 19412 - DNA, 60 bp, Artificial Sequence
  Description of Artificial Sequence: Synthetic probe
gaccctgccgtagctaggacagctaaatcgtttgatcatgaccccttcaacttacaacgg

SEQ ID NO: 19413 - DNA, 60 bp, Artificial Sequence
  Description of Artificial Sequence: Synthetic probe
ggtatcagtggagtgttaggccaacttataccccgtacgataggagcagagagagcgaca

SEQ ID NO: 19414 - DNA, 60 bp, Artificial Sequence
  Description of Artificial Sequence: Synthetic probe
atgagatcttccgtcctggaaataacgaacgaacgaacatatttggagggggtaatcata

SEQ ID NO: 19415 - DNA, 60 bp, Artificial Sequence
  Description of Artificial Sequence: Synthetic probe
gggagacgctgcgtacgagaaactgaagaacgggttggttcaaacacggatcgaagggaa

SEQ ID NO: 19416 - DNA, 60 bp, Artificial Sequence
  Description of Artificial Sequence: Synthetic probe
ttctcaagaggttgcctatatgctgaagcccacatatgaaacgattgtccacgccgagcg

SEQ ID NO: 19417 - DNA, 60 bp, Artificial Sequence
  Description of Artificial Sequence: Synthetic probe
gacgacgcgatggatgtgcagccgctcaaggtcgatactgcgcacacgagaacgcgagtg

SEQ ID NO: 19418 - DNA, 60 bp, Artificial Sequence
  Description of Artificial Sequence: Synthetic probe
gacgtacaaaatgagcacatccgagacgccatcatatctaaacctgttagcaatgacgga

SEQ ID NO: 19419 - DNA, 59 bp, Artificial Sequence
  Description of Artificial Sequence: Synthetic probe
tggatcgatccaaatctgtttggcattcgcggacagcataatcagatcaaacgtgaagt

SEQ ID NO: 19420 - DNA, 59 bp, Artificial Sequence
  Description of Artificial Sequence: Synthetic probe
tggatcgatccaaatctgtttggcattcgcggacagcacaatcagatcaaacgtgaagt

SEQ ID NO: 19421 - DNA, 59 bp, Artificial Sequence
  Description of Artificial Sequence: Synthetic probe
tggatcgatccaaatctgtttggcattcgcggacagcacaatcaaatcaaacgtgaagt

SEQ ID NO: 19422 - DNA, 60 bp, Artificial Sequence
  Description of Artificial Sequence: Synthetic probe
ggatgcggctgatgattggatcgatccaaatctgtttggcattcgcggacagcacaatca

SEQ ID NO: 19423 - DNA, 60 bp, Artificial Sequence
  Description of Artificial Sequence: Synthetic probe
ggatgcggctgatgattggatcgatccaaatctgtttggcattcgcggacagcataatca

SEQ ID NO: 19424 - DNA, 60 bp, Artificial Sequence
  Description of Artificial Sequence: Synthetic probe
gtctacgcttgctgatgtttatactgttttgagacctgagttcgcgattcatggcgtaaa

SEQ ID NO: 19425 - DNA, 60 bp, Artificial Sequence
  Description of Artificial Sequence: Synthetic probe
tgttgtctacgcttgcagatgtttatactgttttgagacctgagttcgcgattcatggcg

SEQ ID NO: 19426 - DNA, 55 bp, Artificial Sequence
  Description of Artificial Sequence: Synthetic probe
gagtgtggcatttaaacttaatggcacatcagcggaaataccacagtggtttaag

SEQ ID NO: 19427 - DNA, 50 bp, Artificial Sequence
  Description of Artificial Sequence: Synthetic probe
cgccccgaggtttgcaccgcgtggagtggtgatccagcgatgcaaatcct

SEQ ID NO: 19428 - DNA, 60 bp, Artificial Sequence
  Description of Artificial Sequence: Synthetic probe
atcgaaaaggtatgagttacagtgtgtgggtgcgtgtgagcgtgttgcttttgtctctaa

SEQ ID NO: 19429 - DNA, 60 bp, Artificial Sequence
  Description of Artificial Sequence: Synthetic probe
cagtggtttaagagtttaaatccaatgctcggagtggtaaatctaggtgcaactttcata

SEQ ID NO: 19430 - DNA, 60 bp, Artificial Sequence
  Description of Artificial Sequence: Synthetic probe
atatgagcgtggcatttaagctaaatggtacatcagctgagatacctcaatggtttaaga

SEQ ID NO: 19431 - DNA, 60 bp, Artificial Sequence
  Description of Artificial Sequence: Synthetic probe
tgatatgagcgtggcgtttaagctaaacggtacatcagctgagatacctcaatggtttaa

SEQ ID NO: 19432 - DNA, 60 bp, Artificial Sequence
  Description of Artificial Sequence: Synthetic probe
aaaacaatcgtataatgatgcggtcaggatgagctttacagaattttcatcagtcccgct

SEQ ID NO: 19433 - DNA, 60 bp, Artificial Sequence
  Description of Artificial Sequence: Synthetic probe
gggctaccttcctgatgatggtttgcgcgaaaagcgagggaactttgaaccagcaaattg

SEQ ID NO: 19434 - DNA, 60 bp, Artificial Sequence
  Description of Artificial Sequence: Synthetic probe
gctgagataccccaatggtttaagagtttgaatccaatgctaggtgtggtgaatttgggg

SEQ ID NO: 19435 - DNA, 60 bp, Artificial Sequence
  Description of Artificial Sequence: Synthetic probe
tacatcagctgagataccccaatggtttaagagtttgaatccaatgctaggtgtggtgaa

SEQ ID NO: 19436 - DNA, 60 bp, Artificial Sequence
  Description of Artificial Sequence: Synthetic probe
acctaggaggcctaaagaagaaaagagctataatacacatgacactactgatagcggcgg

SEQ ID NO: 19437 - DNA, 60 bp, Artificial Sequence
  Description of Artificial Sequence: Synthetic probe
agtgacctaggaggcctaaagaagaaaagagctataatacacatgacactactgatagcg

SEQ ID NO: 19438 - DNA, 60 bp, Artificial Sequence
  Description of Artificial Sequence: Synthetic probe
acacgatttcccaaccgccgagatgtgccccgagtgcgcccatgccatcgtcaatgccta

SEQ ID NO: 19439 - DNA, 60 bp, Artificial Sequence
  Description of Artificial Sequence: Synthetic probe
ggtataggtgtgatgtgatcctaatacagactccgggctacgtcttcggtaacgacgaac

SEQ ID NO: 19440 - DNA, 60 bp, Artificial Sequence
  Description of Artificial Sequence: Synthetic probe
cgagtgatatgagcgtggcgtttaagctaaacggtacatcagctgagatacctcaatggt

SEQ ID NO: 19441 - DNA, 50 bp, Artificial Sequence
  Description of Artificial Sequence: Synthetic probe
ggggacgcaagcagaggaagaaaacccatggtgacgcgcagagagaaggt

SEQ ID NO: 19442 - DNA, 60 bp, Artificial Sequence
  Description of Artificial Sequence: Synthetic probe
gctgcggcgaatgattttgaagatttgatgctgactgatcaagtatatatgcatagagat

SEQ ID NO: 19443 - DNA, 60 bp, Artificial Sequence
  Description of Artificial Sequence: Synthetic probe
ctagacgtatgataaggtcgaaaacagtacaccccatttacttgggttcgatgcattatg

SEQ ID NO: 19444 - DNA, 60 bp, Artificial Sequence
  Description of Artificial Sequence: Synthetic probe
tgctagacgtatgataaggtcgaaaacagtacaccccatttacttgggttcgatgcatta

SEQ ID NO: 19445 - DNA, 60 bp, Artificial Sequence
  Description of Artificial Sequence: Synthetic probe
ctggcgattagcaatacgtatacatctccaatgcatgctagacgtatgataaggtcgaaa

SEQ ID NO: 19446 - DNA, 60 bp, Artificial Sequence
  Description of Artificial Sequence: Synthetic probe
acagaagcagcgaatgagatagctcgtgtgactggggagacttcgacgtggggaccagcg

SEQ ID NO: 19447 - DNA, 60 bp, Artificial Sequence
  Description of Artificial Sequence: Synthetic probe
ggatatgtgctgaatgttccaggaccaggtgcatacagaattcaggatgggcaagatatc

SEQ ID NO: 19448 - DNA, 60 bp, Artificial Sequence
  Description of Artificial Sequence: Synthetic probe
aatgcctggcccgctcacgcgagcaatcgcgcgcgccgcttatgtgtagcccactttgca

SEQ ID NO: 19449 - DNA, 60 bp, Artificial Sequence
  Description of Artificial Sequence: Synthetic probe
taaggtgtgtaaaaagactttgctgaagcatcgatgtgacgttattctgttacagactcc

SEQ ID NO: 19450 - DNA, 60 bp, Artificial Sequence
  Description of Artificial Sequence: Synthetic probe
tcccgttaagtgcttagtcgctttagaagtatctgatgcattagttggagcggatgtacg

SEQ ID NO: 19451 - DNA, 60 bp, Artificial Sequence
  Description of Artificial Sequence: Synthetic probe
cgtgtcgactaaggcgctgctttatgagatgtatttatcttctatatgcggcgggtactc

SEQ ID NO: 19452 - DNA, 60 bp, Artificial Sequence
  Description of Artificial Sequence: Synthetic probe
tggaggtgtacagacaagtatcgtgtcgactaaggcgctgctttatgagatgtatttatc

SEQ ID NO: 19453 - DNA, 60 bp, Artificial Sequence
  Description of Artificial Sequence: Synthetic probe
cagacgacgatctcaaatggaggtgtacagacaagtatcgtgtcgactaaggcgctgctt

SEQ ID NO: 19454 - DNA, 60 bp, Artificial Sequence
  Description of Artificial Sequence: Synthetic probe
gaacttttatcttcagacgacgatctcaaatggaggtgtacagacaagtatcgtgtcgac

SEQ ID NO: 19455 - DNA, 60 bp, Artificial Sequence
  Description of Artificial Sequence: Synthetic probe
aagaggcgggtgctacgatcgatcgacgaaagtagatggatccttcatctgatcagaata

SEQ ID NO: 19456 - DNA, 60 bp, Artificial Sequence
  Description of Artificial Sequence: Synthetic probe
tagttcacatgtatgacagattttttgagaagagacgggtgctgcgatcgatcgacgaaa

SEQ ID NO: 19457 - DNA, 60 bp, Artificial Sequence
  Description of Artificial Sequence: Synthetic probe
ggcgcgatgcggatttagattatagttcgccatgtcctattataacgaactattttctgt

SEQ ID NO: 19458 - DNA, 60 bp, Artificial Sequence
  Description of Artificial Sequence: Synthetic probe
gataccatatgtctcattactatgatttaagaccgtctctcaagggagtgagtttatcga

SEQ ID NO: 19459 - DNA, 60 bp, Artificial Sequence
  Description of Artificial Sequence: Synthetic probe
ttggcggagaggaaaaacgatgatccattcgtaaaaagaaccttgaaaccgatcaaggca

SEQ ID NO: 19460 - DNA, 60 bp, Artificial Sequence
  Description of Artificial Sequence: Synthetic probe
gacgcatgccccgatgtttaatgctcgagttaaaccatgtgatatagagttggcggagag

SEQ ID NO: 19461 - DNA, 60 bp, Artificial Sequence
  Description of Artificial Sequence: Synthetic probe
tgatgatgggtgggaccaaaagaatcttaaaatgtataagatccttgaggaagaaggtaa

SEQ ID NO: 19462 - DNA, 60 bp, Artificial Sequence
  Description of Artificial Sequence: Synthetic probe
cgtgagatgatccagacggtaattgatgatgggtgggaccaaaagaatcttaaaatgtat

SEQ ID NO: 19463 - DNA, 60 bp, Artificial Sequence
  Description of Artificial Sequence: Synthetic probe
gaagatagatatcgtgagatgatccagtcggtaattgatgatgggtgggaccaaaagaat

SEQ ID NO: 19464 - DNA, 60 bp, Artificial Sequence
  Description of Artificial Sequence: Synthetic probe
acgactaaatttaatgaagatagatatcgtgagatgatccagtcggtaattgatgatggg

SEQ ID NO: 19465 - DNA, 60 bp, Artificial Sequence
  Description of Artificial Sequence: Synthetic probe
ggacgtgtcaatttgtttgacctcgaaggtgagccagtgaagaaggtcatactttgggag

SEQ ID NO: 19466 - DNA, 60 bp, Artificial Sequence
  Description of Artificial Sequence: Synthetic probe
aagtacgtcgttggacgtgtcaatttgtttgacctcgaaggtgagccagcgacgaaggtc

SEQ ID NO: 19467 - DNA, 60 bp, Artificial Sequence
  Description of Artificial Sequence: Synthetic probe
tggaacgcgagagagagaagtacgtcgttggacgtgtcaatttgtttgacctcgaaggtg

SEQ ID NO: 19468 - DNA, 60 bp, Artificial Sequence
  Description of Artificial Sequence: Synthetic probe
acaagccaaaagatctggaacgcgagagagagaagtacgtcgttggacgtgtcaatttgt

SEQ ID NO: 19469 - DNA, 60 bp, Artificial Sequence
  Description of Artificial Sequence: Synthetic probe
gggcgctccacagtttcatacaatacagaggaaccatcgtatgcagttaggagataacgc

SEQ ID NO: 19470 - DNA, 60 bp, Artificial Sequence
  Description of Artificial Sequence: Synthetic probe
gagtgggcgctccgcagtttcatacaatacagaggaaccatcgtatgcagttaggagata

SEQ ID NO: 19471 - DNA, 60 bp, Artificial Sequence
  Description of Artificial Sequence: Synthetic probe
ggaagaggaatttagagtgggcgctccgcagtttcatacaatacagaggaaccatcgtat

SEQ ID NO: 19472 - DNA, 60 bp, Artificial Sequence
  Description of Artificial Sequence: Synthetic probe
ttgtcaattctgaacggttgtcaacggaagaggaatttagagtgggtgctccgcagtttc

SEQ ID NO: 19473 - DNA, 60 bp, Artificial Sequence
  Description of Artificial Sequence: Synthetic probe
tatgaactgattgttaactctgaacggttgtcaacggaagaggaatttagagtgggcgct

SEQ ID NO: 19474 - DNA, 60 bp, Artificial Sequence
  Description of Artificial Sequence: Synthetic probe
ctagaaaagcagacaccacatcgtaccacgcaatcgctgttgagacgaaggccgagcgta

SEQ ID NO: 19475 - DNA, 60 bp, Artificial Sequence
  Description of Artificial Sequence: Synthetic probe
catatcgattctagaaaagcagacaccacatcgtaccacgcaatcgctgttgaggcgaaa

SEQ ID NO: 19476 - DNA, 60 bp, Artificial Sequence
  Description of Artificial Sequence: Synthetic probe
cgaacacgagatggcttgagtggatgattcaagattcgatggatgtacagccattgcgtg

SEQ ID NO: 19477 - DNA, 60 bp, Artificial Sequence
  Description of Artificial Sequence: Synthetic probe
tcgattttgtttcgaacacgagatggcttgagtggatgattcaagattcgatggatgtac

SEQ ID NO: 19478 - DNA, 60 bp, Artificial Sequence
  Description of Artificial Sequence: Synthetic probe
cgacgttacacagataccaggcaggcggatgtttgatgtagcgcagcaaggcatcaggga

SEQ ID NO: 19479 - DNA, 60 bp, Artificial Sequence
  Description of Artificial Sequence: Synthetic probe
gtggagattacgcaaatgccacgagaacttttttggctatttcaccacaatggacttgca

SEQ ID NO: 19480 - DNA, 51 bp, Artificial Sequence
  Description of Artificial Sequence: Synthetic probe
tgttggaacgagactcagggagacaagcgcggattgattagtgcaactaaa

SEQ ID NO: 19481 - DNA, 60 bp, Artificial Sequence
  Description of Artificial Sequence: Synthetic probe
atgcgagcatgcgctacgcttcaagaagcaagaattgtgttggaagccaatgtgatggaa

SEQ ID NO: 19482 - DNA, 60 bp, Artificial Sequence
  Description of Artificial Sequence: Synthetic probe
gatgcgagcatgcgctacgcttcaagaagcaagaattgtgttggaagccaatgtgatgga

SEQ ID NO: 19483 - DNA, 60 bp, Artificial Sequence
  Description of Artificial Sequence: Synthetic probe
ggatcatttcgaggttccctctcagtccgaagcatttaagaggtatcgcgttaactgcag

SEQ ID NO: 19484 - DNA, 60 bp, Artificial Sequence
  Description of Artificial Sequence: Synthetic probe
ccgacatccatagtggagggattatgcgcaatgtagtgacaacgaaacgcttgctatatg

SEQ ID NO: 19485 - DNA, 60 bp, Artificial Sequence
  Description of Artificial Sequence: Synthetic probe
cggcgacaacatggctttcgctcataggcagtggagtatacctgtcctgctatacgctca

SEQ ID NO: 19486 - DNA, 60 bp, Artificial Sequence
  Description of Artificial Sequence: Synthetic probe
cacacaccttgatattgatacctggaaaatcgcagacatttcccaacttatggtgctact

SEQ ID NO: 19487 - DNA, 60 bp, Artificial Sequence
  Description of Artificial Sequence: Synthetic probe
cgaccgggattgatgggacgagcgttatctaaagagcaggaagggtcggctatagcgagt

SEQ ID NO: 19488 - DNA, 60 bp, Artificial Sequence
  Description of Artificial Sequence: Synthetic probe
agcgataaatacatatatagccgagtgaacctgttcgatttgcaacgcttagacctggcg

SEQ ID NO: 19489 - DNA, 60 bp, Artificial Sequence
  Description of Artificial Sequence: Synthetic probe
tggagttggatgagattttccgcccaggaaataacgagcgaacaaatatatttggagggg

SEQ ID NO: 19490 - DNA, 60 bp, Artificial Sequence
  Description of Artificial Sequence: Synthetic probe
ggctgcaatggatgatcgacgacgcgatggatgtgcagccgctcaaagttgataccgcgc

SEQ ID NO: 19491 - DNA, 60 bp, Artificial Sequence
  Description of Artificial Sequence: Synthetic probe
gtgtcgcgatggacgagttagcaattccaatatacacggatgtattccccgcggagttgt

SEQ ID NO: 19492 - DNA, 60 bp, Artificial Sequence
  Description of Artificial Sequence: Synthetic probe
aacggagaaggctgcatacgcatcgtacgcagaagcgtttcgtgatgatgtaagattaag

SEQ ID NO: 19493 - DNA, 60 bp, Artificial Sequence
  Description of Artificial Sequence: Synthetic probe
cgccacatcatttgaacgaatcattcttcttgggctttgatttagaaatcgagtatgtgc

SEQ ID NO: 19494 - DNA, 60 bp, Artificial Sequence
  Description of Artificial Sequence: Synthetic probe
tatcaagcgctatgcctcaagcgagcggtggatttgatcgtatgattgtaacgaagaagc

SEQ ID NO: 19495 - DNA, 60 bp, Artificial Sequence
  Description of Artificial Sequence: Synthetic probe
tggttgggcgacgattgatgtcgagtatagagaacctgcgccctacgtacatgctcagcg

SEQ ID NO: 19496 - DNA, 60 bp, Artificial Sequence
  Description of Artificial Sequence: Synthetic probe
ggacgatttactaacctaactcaaaatatggctcgtcagttggacattgcgctgaacgac

SEQ ID NO: 19497 - DNA, 60 bp, Artificial Sequence
  Description of Artificial Sequence: Synthetic probe
agttccaactggtgaatttccattgcatcagatgatgttgatgagacgcgacttccccac

SEQ ID NO: 19498 - DNA, 55 bp, Artificial Sequence
  Description of Artificial Sequence: Synthetic probe
agatcacagcaaccgcaaattcatatttatacggcgccatgggattctgatgatg

SEQ ID NO: 19499 - DNA, 60 bp, Artificial Sequence
  Description of Artificial Sequence: Synthetic probe
gaatccaatgttgggtgtggtaaatctgggagctaccttcctgatgatggtctgtgcaaa

SEQ ID NO: 19500 - DNA, 60 bp, Artificial Sequence
  Description of Artificial Sequence: Synthetic probe
gggatctggatcaagcacaaaaggacctggagaacgcgcgaacgagaatgctgacagagg

SEQ ID NO: 19501 - DNA, 60 bp, Artificial Sequence
  Description of Artificial Sequence: Synthetic probe
ggagctactggagcgaatggaggaagatgggtagttctaacagaagagattgctcgcgcg

SEQ ID NO: 19502 - DNA, 60 bp, Artificial Sequence
  Description of Artificial Sequence: Synthetic probe
acacaaaaggcggaaaaagctgcattcgcatcgtacgcagaagcgtttcgtgatgatgtg

SEQ ID NO: 19503 - DNA, 60 bp, Artificial Sequence
  Description of Artificial Sequence: Synthetic probe
cgccacatcatttgaacgaatcattcttctggggctttgatttagaaatcgagtatgtgc

SEQ ID NO: 19504 - DNA, 57 bp, Artificial Sequence
  Description of Artificial Sequence: Synthetic probe
agaaaaaacgtctgaggagccggcatgcattggaattactatagagggggtcatgag

SEQ ID NO: 19505 - DNA, 60 bp, Artificial Sequence
  Description of Artificial Sequence: Synthetic probe
aagagtttgaatccaatgttgggtgtgataaatctgggagctaccttcctgatgatggtt

SEQ ID NO: 19506 - DNA, 60 bp, Artificial Sequence
  Description of Artificial Sequence: Synthetic probe
cgctagctcgaggatggaagagcttgtgatacccgtgataaccgaacgattcgataaaag

SEQ ID NO: 19507 - DNA, 60 bp, Artificial Sequence
  Description of Artificial Sequence: Synthetic probe
tgagtgtgaattaggtgacgtttacagtacacttcgacgtgtgtatagatggagtctaag

SEQ ID NO: 19508 - DNA, 60 bp, Artificial Sequence
  Description of Artificial Sequence: Synthetic probe
cggcattcgcggacagcacaatcaaattaaacgtgaggttgagagacaagttaacacatg

SEQ ID NO: 19509 - DNA, 60 bp, Artificial Sequence
  Description of Artificial Sequence: Synthetic probe
atctgttcggcattcgcggacagcacaatcaaattaaacgtgaggttgagagacaagtta

SEQ ID NO: 19510 - DNA, 60 bp, Artificial Sequence
  Description of Artificial Sequence: Synthetic probe
accattaacctaagatcagtaggtagagtggcgccccaaggtttgcatcatgtggagtgg

SEQ ID NO: 19511 - DNA, 56 bp, Artificial Sequence
  Description of Artificial Sequence: Synthetic probe
caggtcacgagcagtacacccaatctttctaggatcaatgcactacgatattacat

SEQ ID NO: 19512 - DNA, 60 bp, Artificial Sequence
  Description of Artificial Sequence: Synthetic probe
cagtaagtgtgttgaataaaaagacagccgtgactgataactgcaatgagatcgcgcata

SEQ ID NO: 19513 - DNA, 60 bp, Artificial Sequence
  Description of Artificial Sequence: Synthetic probe
cgctacgacattggagcaccgatttagagaaataccagatgaacagctagcagtaagtgt

SEQ ID NO: 19514 - DNA, 60 bp, Artificial Sequence
  Description of Artificial Sequence: Synthetic probe
taaattgaagaaggttataaacgcgctaagtggaatcgatttgtcgcatatgaggagccc

SEQ ID NO: 19515 - DNA, 60 bp, Artificial Sequence
  Description of Artificial Sequence: Synthetic probe
cccctaattggtgcaggtatggctactgctgtagcgaccggcagggcaatagaaggcgca

SEQ ID NO: 19516 - DNA, 60 bp, Artificial Sequence
  Description of Artificial Sequence: Synthetic probe
tggtaaaggagtacagacagaagatcgatgcgcttaaaaatgcgattgagattgaacgag

SEQ ID NO: 19517 - DNA, 60 bp, Artificial Sequence
  Description of Artificial Sequence: Synthetic probe
aaaggcagaggattcgaaaatggcgatgttggcgcgcgcactgcagcgggaagcttcaga

SEQ ID NO: 19518 - DNA, 60 bp, Artificial Sequence
  Description of Artificial Sequence: Synthetic probe
acgaaagagtttgggaaggagctagaggaagtctacgacttcatgaatggcgaggcgaag

SEQ ID NO: 19519 - DNA, 60 bp, Artificial Sequence
  Description of Artificial Sequence: Synthetic probe
ggtttggtgcagggcagtgttcattccataattacaggtgaatcatatggagaatcggtt

SEQ ID NO: 19520 - DNA, 60 bp, Artificial Sequence
  Description of Artificial Sequence: Synthetic probe
ccattgggaaagcagcggagcgatttgctgagagtgaaatcggtgcggcgacaatagatg

SEQ ID NO: 19521 - DNA, 60 bp, Artificial Sequence
  Description of Artificial Sequence: Synthetic probe
tgaccgccgatgtattggaggcggcatcggaagaggtaccgctaataggtgctgggatgg

SEQ ID NO: 19522 - DNA, 60 bp, Artificial Sequence
  Description of Artificial Sequence: Synthetic probe
cgacaagttagaaccgcatgcgcgttcggaacagatagttagtcggtataattactcacg

SEQ ID NO: 19523 - DNA, 60 bp, Artificial Sequence
  Description of Artificial Sequence: Synthetic probe
taaaccagcgagaaacgatgggatcgttgtacctagattacttgatataacattacgcgc

SEQ ID NO: 19524 - DNA, 60 bp, Artificial Sequence
  Description of Artificial Sequence: Synthetic probe
agaggcgatgaattataaaccagcgagaaacgatgggatcgttgtacctagattacttga

SEQ ID NO: 19525 - DNA, 60 bp, Artificial Sequence
  Description of Artificial Sequence: Synthetic probe
atcatattgccggtcggtgtttaggcgcttgtgaccgcgtggttagggggggattttaca

SEQ ID NO: 19526 - DNA, 60 bp, Artificial Sequence
  Description of Artificial Sequence: Synthetic probe
tggatgtggtgacctacgtaccttaatgcagttcaagaaacggtcaccaggacggtttag

SEQ ID NO: 19527 - DNA, 60 bp, Artificial Sequence
  Description of Artificial Sequence: Synthetic probe
agaggtgcactatgttggatgtggtgacctacgtaccttaatgcagttcaagaaacggtc

SEQ ID NO: 19528 - DNA, 60 bp, Artificial Sequence
  Description of Artificial Sequence: Synthetic probe
aagagccttaacccgatgcttggcgttgtcaatttgggggcaacttttctgatgatggtt

SEQ ID NO: 19529 - DNA, 60 bp, Artificial Sequence
  Description of Artificial Sequence: Synthetic probe
ggagctactggaacgaatggaggaagatgggtagttctgacggaagagattgctcgcgcg

SEQ ID NO: 19530 - DNA, 60 bp, Artificial Sequence
  Description of Artificial Sequence: Synthetic probe
ctgatgcgggagttggagctactggaacgaatggaggaagatgggtagttctgacggaag

SEQ ID NO: 19531 - DNA, 60 bp, Artificial Sequence
  Description of Artificial Sequence: Synthetic probe
gtgagagagccttgaaccagcagatagatatgataaagaaggaagtgatgaaaaaacaat

SEQ ID NO: 19532 - DNA, 60 bp, Artificial Sequence
  Description of Artificial Sequence: Synthetic probe
aggctccctctctcatccccattttccgtttgtattcccttaacgcagcaatcagatcat

SEQ ID NO: 19533 - DNA, 60 bp, Artificial Sequence
  Description of Artificial Sequence: Synthetic probe
tggagcaaaagcaacgtagatttaccaaaaacatttttgtcttggacgtaaccgctaaaa

SEQ ID NO: 19534 - DNA, 60 bp, Artificial Sequence
  Description of Artificial Sequence: Synthetic probe
cgcggtgaggatgaatttaccagagttttcgtcaatccccttagatgggttcgaaatgcc

SEQ ID NO: 19535 - DNA, 60 bp, Artificial Sequence
  Description of Artificial Sequence: Synthetic probe
cggtgtgttacgcactgtacgtgttaaattcttcgatgcgcggcccccagacgacatttt

SEQ ID NO: 19536 - DNA, 60 bp, Artificial Sequence
  Description of Artificial Sequence: Synthetic probe
gacgcatacatactgcagtgggatctggatcaagcacaaaaggacctggagaacgcgcga

SEQ ID NO: 19537 - DNA, 60 bp, Artificial Sequence
  Description of Artificial Sequence: Synthetic probe
gacgcatacatactgcagtgggatctggatcaagcacaaaaggacttggagaacgcgcga

SEQ ID NO: 19538 - DNA, 60 bp, Artificial Sequence
  Description of Artificial Sequence: Synthetic probe
gaatgcaatggtacagatccaagttgtgttttatatttcaatggataagacgctaaatca

SEQ ID NO: 19539 - DNA, 60 bp, Artificial Sequence
  Description of Artificial Sequence: Synthetic probe
ctcaacagaatgcaatggtacagatccaagttgtgttttatatttcaatggataagacgc

SEQ ID NO: 19540 - DNA, 60 bp, Artificial Sequence
  Description of Artificial Sequence: Synthetic probe
tcctactcaacagaatgcaatggtacagatccaagttgtgttttatatttcaatggataa

SEQ ID NO: 19541 - DNA, 50 bp, Artificial Sequence
  Description of Artificial Sequence: Synthetic probe
aagggttagatcatccggatcggtgggaatggcttattgattacatggat

SEQ ID NO: 19542 - DNA, 60 bp, Artificial Sequence
  Description of Artificial Sequence: Synthetic probe
gccaattcagctgatcaatttcttgaggatggatgattttgcgaagcattttaacaggta

SEQ ID NO: 19543 - DNA, 60 bp, Artificial Sequence
  Description of Artificial Sequence: Synthetic probe
cgcagatggatgatgatgaatgggaatcgaccagattcgcagaggataggttgggtgagg

SEQ ID NO: 19544 - DNA, 60 bp, Artificial Sequence
  Description of Artificial Sequence: Synthetic probe
gcctggttcgcgtggatgatacggtttcacagcctccgagatatgctccgagtgccccaa

SEQ ID NO: 19545 - DNA, 60 bp, Artificial Sequence
  Description of Artificial Sequence: Synthetic probe
ctcgcggcgtagattcccactgctgtataacgggggagggtgcgcgatactacacactta

SEQ ID NO: 19546 - DNA, 60 bp, Artificial Sequence
  Description of Artificial Sequence: Synthetic probe
gagtggaggaagatgggtagttctaacagaagagattgctcgcgcgatcgaatctaaata

SEQ ID NO: 19547 - DNA, 60 bp, Artificial Sequence
  Description of Artificial Sequence: Synthetic probe
gaatggaggaagatgggtagttctaacagaagagattgctcgcgcgatcgaatctaaata

SEQ ID NO: 19548 - DNA, 53 bp, Artificial Sequence
  Description of Artificial Sequence: Synthetic probe
ccagctcagatcatcgaggtggaacgcagtctccagaaagagttgggaatttc

SEQ ID NO: 19549 - DNA, 60 bp, Artificial Sequence
  Description of Artificial Sequence: Synthetic probe
ggcggcgctgtctatactttccggcgagtagccctcgcgttaattgctaactatgagaag

SEQ ID NO: 19550 - DNA, 60 bp, Artificial Sequence
  Description of Artificial Sequence: Synthetic probe
gggcggcgctgtctatactttccggcgagtagccctcgcgttaattgctaactatgagaa

SEQ ID NO: 19551 - DNA, 60 bp, Artificial Sequence
  Description of Artificial Sequence: Synthetic probe
ccagggttgacgcattataagagagatgacgttgtgtgtccccatgcgggcggcgctgtc

SEQ ID NO: 19552 - DNA, 60 bp, Artificial Sequence
  Description of Artificial Sequence: Synthetic probe
ttcccagggttgacgcattataagagagatgacgttgtgtgtccccatgcgggcggcgct

SEQ ID NO: 19553 - DNA, 60 bp, Artificial Sequence
  Description of Artificial Sequence: Synthetic probe
gacgcaatctactgtattcgcttacatgggtcagcaggaggatttcccagggttgacgca

SEQ ID NO: 19554 - DNA, 60 bp, Artificial Sequence
  Description of Artificial Sequence: Synthetic probe
aaaagcagacgcaatctactgtattcgcttacatgggtcagcaggaggatttcccagggt

SEQ ID NO: 19555 - DNA, 60 bp, Artificial Sequence
  Description of Artificial Sequence: Synthetic probe
gagggtactatgatatgcgtttgcagttgtttggtgaaacgttaagccaaaagcagacgc

SEQ ID NO: 19556 - DNA, 60 bp, Artificial Sequence
  Description of Artificial Sequence: Synthetic probe
aggagggtactatgatatgcgtttgcagttgtttggtgaaacgttaagccaaaagcagac

SEQ ID NO: 19557 - DNA, 60 bp, Artificial Sequence
  Description of Artificial Sequence: Synthetic probe
gctgtacacggttatgttaagatgtcatctgattcattgggttacgcattaggagggtac

SEQ ID NO: 19558 - DNA, 60 bp, Artificial Sequence
  Description of Artificial Sequence: Synthetic probe
ggtacagctagaagtaacgatccatggaataaacgagctgtacacggttatgttaagatg

SEQ ID NO: 19559 - DNA, 60 bp, Artificial Sequence
  Description of Artificial Sequence: Synthetic probe
ctcacggagagatcggtacagctagaagtaacgatccatggaataaacgagctgtacacg

SEQ ID NO: 19560 - DNA, 60 bp, Artificial Sequence
  Description of Artificial Sequence: Synthetic probe
caactctccaatgtttaacgcacgtttgagaataactcacggagagatcggtacagctag

SEQ ID NO: 19561 - DNA, 60 bp, Artificial Sequence
  Description of Artificial Sequence: Synthetic probe
tttcgataaatggatcaactctccaatgtttaacgcacgtttgagaataactcacggaga

SEQ ID NO: 19562 - DNA, 60 bp, Artificial Sequence
  Description of Artificial Sequence: Synthetic probe
gacgcctttctgaattcaaggtcggaattaatactgcctgattatttcgataaatggatc

SEQ ID NO: 19563 - DNA, 60 bp, Artificial Sequence
  Description of Artificial Sequence: Synthetic probe
gagaaggacgcctttctgaattcaaggtcggaattaatactgcctgattatttcgataaa

SEQ ID NO: 19564 - DNA, 60 bp, Artificial Sequence
  Description of Artificial Sequence: Synthetic probe
ggtataaagagatgttggatagaatgattcaaggtgggtgggatcaagagcggttcaaac

SEQ ID NO: 19565 - DNA, 60 bp, Artificial Sequence
  Description of Artificial Sequence: Synthetic probe
cgagatgctgacaaaacttctcaacgtatgatctgcttgaccgcagatccgcgcactatt

SEQ ID NO: 19566 - DNA, 60 bp, Artificial Sequence
  Description of Artificial Sequence: Synthetic probe
cgagatgctaacaaaacttctcaacgtatgatctgcttgaccgcagatccgcgcactatt

SEQ ID NO: 19567 - DNA, 60 bp, Artificial Sequence
  Description of Artificial Sequence: Synthetic probe
caatgatcggtgcggattaatagcgtacctggaatacatggttttctttccctccaaggc

SEQ ID NO: 19568 - DNA, 54 bp, Artificial Sequence
  Description of Artificial Sequence: Synthetic probe
aacatgatatactctcataggcagtggtctattcccttacttctatatactcat

SEQ ID NO: 19569 - DNA, 60 bp, Artificial Sequence
  Description of Artificial Sequence: Synthetic probe
attgaacgtgatcgcggagtttttcccaacctatgggggtcttctaaatgggttaaacag

SEQ ID NO: 19570 - DNA, 60 bp, Artificial Sequence
  Description of Artificial Sequence: Synthetic probe
attgaacgtgatcgcggagtttttcccaacctatgggagtcttctaaatggattaagtgg

SEQ ID NO: 19571 - DNA, 60 bp, Artificial Sequence
  Description of Artificial Sequence: Synthetic probe
agaggtataaagagatgttggatagaatgattcaaggtgggtgggatcaagagcggttca

SEQ ID NO: 19572 - DNA, 60 bp, Artificial Sequence
  Description of Artificial Sequence: Synthetic probe
taaagagagattgaacgtgatcgcggagtttttcccaacctatgggagtcttctaaatgg

SEQ ID NO: 19573 - DNA, 60 bp, Artificial Sequence
  Description of Artificial Sequence: Synthetic probe
gactttggcgcggttttacgacattcgtcccgctttaagaggacaggcgctttcgcggca

SEQ ID NO: 19574 - DNA, 60 bp, Artificial Sequence
  Description of Artificial Sequence: Synthetic probe
gactttggcgcgattttacgacattcgtcccgctttaagaggacaggcactttcgcgaca

SEQ ID NO: 19575 - DNA, 60 bp, Artificial Sequence
  Description of Artificial Sequence: Synthetic probe
gcaaagactgactttggcgcgattttacgacattcgtcccgctttaagaggacaggcgct

SEQ ID NO: 19576 - DNA, 60 bp, Artificial Sequence
  Description of Artificial Sequence: Synthetic probe
cgaattacaaagattgactttggcgcgattttacgacattcgtcccgctttaagaggaca

SEQ ID NO: 19577 - DNA, 60 bp, Artificial Sequence
  Description of Artificial Sequence: Synthetic probe
gcgtaacgatgccagaatatttcaataagtggataatcgctccgatgttcaatgctaacg

SEQ ID NO: 19578 - DNA, 60 bp, Artificial Sequence
  Description of Artificial Sequence: Synthetic probe
ccaacgaaggcgtaacaatgccagaatatttcaataagtggataatcgctccgatgttca

SEQ ID NO: 19579 - DNA, 60 bp, Artificial Sequence
  Description of Artificial Sequence: Synthetic probe
taacaaccaatgaaggcgtaacgatgccagaatatttcaataagtggataatcgctccga

SEQ ID NO: 19580 - DNA, 60 bp, Artificial Sequence
  Description of Artificial Sequence: Synthetic probe
ctaacaaccaatgaaggcgtaacgatgccagaatatttcaataagtggataatcgctccg

SEQ ID NO: 19581 - DNA, 60 bp, Artificial Sequence
  Description of Artificial Sequence: Synthetic probe
aaaagacgatgaactattatgtaaagtggatgaggagaggtataaagagatgttggatag

SEQ ID NO: 19582 - DNA, 54 bp, Artificial Sequence
  Description of Artificial Sequence: Synthetic probe
tgcgcaagggaacccatgtgatttatacccagaggatgatgatgtaatagtcac

SEQ ID NO: 19583 - DNA, 55 bp, Artificial Sequence
  Description of Artificial Sequence: Synthetic probe
tgcgcaagggaacccatgtgatttatacccagaggatgatgatgtaatagtcaca

SEQ ID NO: 19584 - DNA, 60 bp, Artificial Sequence
  Description of Artificial Sequence: Synthetic probe
tcattccacccgggagataacctatgcacaagggaacccatgtgatttatacccagagga

SEQ ID NO: 19585 - DNA, 60 bp, Artificial Sequence
  Description of Artificial Sequence: Synthetic probe
cggttctatattctgttgatgattgcagcctccgacacttttaacacacgagtgtggtgg

SEQ ID NO: 19586 - DNA, 60 bp, Artificial Sequence
  Description of Artificial Sequence: Synthetic probe
tcggttctatattctgttgatgattgcagcctccgacacttttaacacacgagtgtggtg

SEQ ID NO: 19587 - DNA, 60 bp, Artificial Sequence
  Description of Artificial Sequence: Synthetic probe
tatcgatccgatttcaagaggcgatcgacaataagttccgacaacatgatcctgagcgcc

SEQ ID NO: 19588 - DNA, 60 bp, Artificial Sequence
  Description of Artificial Sequence: Synthetic probe
cagtcaaccgtttaggccaggggatcagacattaattaattttgggagaggtcagaaggt

SEQ ID NO: 19589 - DNA, 60 bp, Artificial Sequence
  Description of Artificial Sequence: Synthetic probe
gtcaaaatcgattcaaagaaggctgatactatgtcttaccatgtagagccgatagaggac

SEQ ID NO: 19590 - DNA, 60 bp, Artificial Sequence
  Description of Artificial Sequence: Synthetic probe
gtcaaaatcgattcaaagaaggctgatactatgtcttatcatgtagagccgattgaggac

SEQ ID NO: 19591 - DNA, 60 bp, Artificial Sequence
  Description of Artificial Sequence: Synthetic probe
atgtacgcctcaggaaaaagacgatgaactattatgtaaagtggatgaggagaggtataa

SEQ ID NO: 19592 - DNA, 60 bp, Artificial Sequence
  Description of Artificial Sequence: Synthetic probe
ctttgattcaaacttagcggtgggtgatcagatcgttcattggagatatgaattggatga

SEQ ID NO: 19593 - DNA, 60 bp, Artificial Sequence
  Description of Artificial Sequence: Synthetic probe
agtcgtattaatctctttgattcaaacttagcggtgggtgatcagatcgttcattggaga

SEQ ID NO: 19594 - DNA, 60 bp, Artificial Sequence
  Description of Artificial Sequence: Synthetic probe
gccaacgtgataggcagctcgaggataataagtatgtgtttagtcgtattaatctctttg

SEQ ID NO: 19595 - DNA, 60 bp, Artificial Sequence
  Description of Artificial Sequence: Synthetic probe
ctgaatatggccaacgtgataggcagctcgaggataataagtatgtgtttagtcgtatta

SEQ ID NO: 19596 - DNA, 57 bp, Artificial Sequence
  Description of Artificial Sequence: Synthetic probe
ctttatccgtgtcttcgcggagcgataatcgcttctgaatgtgagttgggtgacgta

SEQ ID NO: 19597 - DNA, 60 bp, Artificial Sequence
  Description of Artificial Sequence: Synthetic probe
ctgatacgcaaaggggcagagtctggagaacgaacctttatccgtgtcttcgcggagcga

SEQ ID NO: 19598 - DNA, 60 bp, Artificial Sequence
  Description of Artificial Sequence: Synthetic probe
tcgcgattgcagcgactgatacgcaaaggggcagagtctggagaacgaacctttatccgt

SEQ ID NO: 19599 - DNA, 60 bp, Artificial Sequence
  Description of Artificial Sequence: Synthetic probe
attccagtttaaacttgatgaaaagttcaatactgcggactccgagcatgtgaacatatt

SEQ ID NO: 19600 - DNA, 53 bp, Artificial Sequence
  Description of Artificial Sequence: Synthetic probe
attccagtttaaacttgatgaaaagttcaatactgcggactccgagcatgtga

SEQ ID NO: 19601 - DNA, 60 bp, Artificial Sequence
  Description of Artificial Sequence: Synthetic probe
acaatcgctcaaaatgggcaccaagctggctgcgccgactgtgtagagatgcgacctatc

SEQ ID NO: 19602 - DNA, 60 bp, Artificial Sequence
  Description of Artificial Sequence: Synthetic probe
gtcatcgaaaaggtatgagttacagtgtgtaggtgcgtgtgagcgtgttgcttttgtctc

SEQ ID NO: 19603 - DNA, 60 bp, Artificial Sequence
  Description of Artificial Sequence: Synthetic probe
gttcatgagtttatcaagcgctatgcctcaagcgagaggtggattcgatcgcatgattgt

SEQ ID NO: 19604 - DNA, 60 bp, Artificial Sequence
  Description of Artificial Sequence: Synthetic probe
agccggcacgcattggaattactatagagggggtcatgagtcaaaataaattgctaagca

SEQ ID NO: 19605 - DNA, 60 bp, Artificial Sequence
  Description of Artificial Sequence: Synthetic probe
agccggcacgcattggaattactatagagggggtcatgagtcaaaagaaactgctaagca

SEQ ID NO: 19606 - DNA, 56 bp, Artificial Sequence
  Description of Artificial Sequence: Synthetic probe
aaaagttgcaaagcagattaaattgaagcatgaacggtttatgagtctgtcaagcg

SEQ ID NO: 19607 - DNA, 60 bp, Artificial Sequence
  Description of Artificial Sequence: Synthetic probe
attcgcatcgtacgcggaagcgtttcgtgatgatgtaaggttgagacaaatcaaacgcca

SEQ ID NO: 19608 - DNA, 60 bp, Artificial Sequence
  Description of Artificial Sequence: Synthetic probe
aagcgccaagcatatcttttaggcatattgttatgcaatcaagggatcgagtactgcggg

SEQ ID NO: 19609 - DNA, 60 bp, Artificial Sequence
  Description of Artificial Sequence: Synthetic probe
tgatgatgtgagactcaaacagattaaacgttatgtcaatgaacagatactcccaaagtt

SEQ ID NO: 19610 - DNA, 60 bp, Artificial Sequence
  Description of Artificial Sequence: Synthetic probe
tacaatgacgcggagaggatgagtttcacggagttctcgtcagtcccgctagatggtttc

SEQ ID NO: 19611 - DNA, 60 bp, Artificial Sequence
  Description of Artificial Sequence: Synthetic probe
atgaagaaacaatcatacaatgacgcggagaggatgagtttcacggagttctcgtcagtc

SEQ ID NO: 19612 - DNA, 60 bp, Artificial Sequence
  Description of Artificial Sequence: Synthetic probe
gagcgaaagagggctaaatcaacagattgatatgatcaagaaggaagttatgaagaaaca

SEQ ID NO: 19613 - DNA, 60 bp, Artificial Sequence
  Description of Artificial Sequence: Synthetic probe
agagcgaaagagggctaaatcaacagattgatatgatcaagaaggaagttatgaagaaac

SEQ ID NO: 19614 - DNA, 60 bp, Artificial Sequence
  Description of Artificial Sequence: Synthetic probe
gagagctatcatacacatgacgttgttagttgccgctgtcgtagcgttgttgacgtcggt

SEQ ID NO: 19615 - DNA, 60 bp, Artificial Sequence
  Description of Artificial Sequence: Synthetic probe
gatgatggtttgtgcaaaaagtgaaaggagcttgaaccagcaaattgatatgattaagaa

SEQ ID NO: 19616 - DNA, 60 bp, Artificial Sequence
  Description of Artificial Sequence: Synthetic probe
acgcggtgaggatgagttttacggagttctcgtcaatcccgctggatggtttcgaaatgc

SEQ ID NO: 19617 - DNA, 60 bp, Artificial Sequence
  Description of Artificial Sequence: Synthetic probe
cgtttagacatatcgtaatgcaatcaagagaccgagttttacgagtggacacctactatg

SEQ ID NO: 19618 - DNA, 60 bp, Artificial Sequence
  Description of Artificial Sequence: Synthetic probe
gcacgccaaccatatggcttcttcctagagacagaggaaacgtatcagcctggtcgttgg

SEQ ID NO: 19619 - DNA, 60 bp, Artificial Sequence
  Description of Artificial Sequence: Synthetic probe
cgcacgccaaccatatggcttcttcctagagacagaggaaacgtatcagcctggtcgttg

SEQ ID NO: 19620 - DNA, 60 bp, Artificial Sequence
  Description of Artificial Sequence: Synthetic probe
tctatgcccactgttgcacttgagatcttggacaaagcgatgtcaaatacaacgggtgct

SEQ ID NO: 19621 - DNA, 60 bp, Artificial Sequence
  Description of Artificial Sequence: Synthetic probe
gattctagattggtctgcgcaaaacaaggagcaaaaactacgcgatctaaagaggtctgc

SEQ ID NO: 19622 - DNA, 60 bp, Artificial Sequence
  Description of Artificial Sequence: Synthetic probe
gattctagattggtctgcgcaaaacagggagcaaaaactacgcgatctaaagaggtctgc

SEQ ID NO: 19623 - DNA, 60 bp, Artificial Sequence
  Description of Artificial Sequence: Synthetic probe
gtcattgaagaggtacgagttgcagtgtgtgggtgggtgtgagcgtgttgcttttgtctc

SEQ ID NO: 19624 - DNA, 60 bp, Artificial Sequence
  Description of Artificial Sequence: Synthetic probe
gtattgctttgatgagtcattgaagaggtacgagttgcagtgtgtgggtgggtgtgagcg

SEQ ID NO: 19625 - DNA, 60 bp, Artificial Sequence
  Description of Artificial Sequence: Synthetic probe
taaccaggagagagttgaagaactaagtctggtacgcgtggatgatacaatttcacaacc

SEQ ID NO: 19626 - DNA, 60 bp, Artificial Sequence
  Description of Artificial Sequence: Synthetic probe
gcggaagcgtttcgtgatgatgtgagattgagacagattaaacgccatgttaacgagcag

SEQ ID NO: 19627 - DNA, 60 bp, Artificial Sequence
  Description of Artificial Sequence: Synthetic probe
cgcgatggatgagctaggtatcccagtttataagagaggatttcccgtacatctgcttcg

SEQ ID NO: 19628 - DNA, 60 bp, Artificial Sequence
  Description of Artificial Sequence: Synthetic probe
ccaccaaggtatgccccgagtgcgccgatgccatcatctatgccaacggttgcccttgaa

SEQ ID NO: 19629 - DNA, 60 bp, Artificial Sequence
  Description of Artificial Sequence: Synthetic probe
gtgcggtccggatatgattcaagtgtcactgaatgctggggcgagaggagatgtgcagca

SEQ ID NO: 19630 - DNA, 60 bp, Artificial Sequence
  Description of Artificial Sequence: Synthetic probe
gttggtttatgcgagctgcgcaggctgtaaccgctgtggtgtgcggcccggatatgattc

SEQ ID NO: 19631 - DNA, 60 bp, Artificial Sequence
  Description of Artificial Sequence: Synthetic probe
gaaacggctgatgaactaaaacggatgggattggatttatctggtcatctatacgtcaca

SEQ ID NO: 19632 - DNA, 60 bp, Artificial Sequence
  Description of Artificial Sequence: Synthetic probe
gttacgcttttgaggtgtacgtgaactcaattttgccgtggagtgaacttgatccggagg

SEQ ID NO: 19633 - DNA, 60 bp, Artificial Sequence
  Description of Artificial Sequence: Synthetic probe
cacgtgtggctggagagttagctgaatatatgacttcagaggagatacgattcgatgcgt

SEQ ID NO: 19634 - DNA, 60 bp, Artificial Sequence
  Description of Artificial Sequence: Synthetic probe
cagtgggagatctggttacggtcttcacgcttatgaatatcgagacacgtgtggctggag

SEQ ID NO: 19635 - DNA, 55 bp, Artificial Sequence
  Description of Artificial Sequence: Synthetic probe
gtttccgtaactctgccgatcgcaacatattcacaatcgcaattgactatagtga

SEQ ID NO: 19636 - DNA, 60 bp, Artificial Sequence
  Description of Artificial Sequence: Synthetic probe
caccattttacccgcataagagctcgaatatgatattagcatctttcctattaagcattc

SEQ ID NO: 19637 - DNA, 60 bp, Artificial Sequence
  Description of Artificial Sequence: Synthetic probe
ggtttatactacaccattttacccgcataagagctcgaatatgatattagcatctttcct

SEQ ID NO: 19638 - DNA, 60 bp, Artificial Sequence
  Description of Artificial Sequence: Synthetic probe
caacgttttaagagcgccatactcttggtttgtgaagatgtggggtgtcggagcagatcc

SEQ ID NO: 19639 - DNA, 60 bp, Artificial Sequence
  Description of Artificial Sequence: Synthetic probe
ccaaagaaaattaacaacgttttaagagcgccatactcttggtttgtgaagatgtggggt

SEQ ID NO: 19640 - DNA, 60 bp, Artificial Sequence
  Description of Artificial Sequence: Synthetic probe
taatcaggagagagtcgaagagctaagtctggttcgtgtggatgatacaatttcgcaacc

SEQ ID NO: 19641 - DNA, 60 bp, Artificial Sequence
  Description of Artificial Sequence: Synthetic probe
taatccaacaacatatggcattgggatgacttatcattgctataacgaaatgttacgaat

SEQ ID NO: 19642 - DNA, 60 bp, Artificial Sequence
  Description of Artificial Sequence: Synthetic probe
gctggattcactgcgccggtctgcgagagcggagaagttattaaccttgctgcacgtatg

SEQ ID NO: 19643 - DNA, 60 bp, Artificial Sequence
  Description of Artificial Sequence: Synthetic probe
gccctgatgtttccaggacaaattatactcgatctaaagattgaccctggtgaaaggatg

SEQ ID NO: 19644 - DNA, 60 bp, Artificial Sequence
  Description of Artificial Sequence: Synthetic probe
atgccacgagaacttttttggctatatcacctcaatggacttgcagtcacttaaaaagaa

SEQ ID NO: 19645 - DNA, 60 bp, Artificial Sequence
  Description of Artificial Sequence: Synthetic probe
caccaggacggtttagaagagtgttatggcacgtatatgatccgatagcgccagaatgtc

SEQ ID NO: 19646 - DNA, 53 bp, Artificial Sequence
  Description of Artificial Sequence: Synthetic probe
gctgcgaactcaacttcgcgatagctccgcataatgttttagcagttatgtcc

SEQ ID NO: 19647 - DNA, 60 bp, Artificial Sequence
  Description of Artificial Sequence: Synthetic probe
attagttgtcagtttttgagtttatcttatttgctcattctattttctctcttagcactc

SEQ ID NO: 19648 - DNA, 60 bp, Artificial Sequence
  Description of Artificial Sequence: Synthetic probe
gctgagaaagttcactttgctggattcaccgccccggcatgtgaaagtggggaagtaatc

SEQ ID NO: 19649 - DNA, 60 bp, Artificial Sequence
  Description of Artificial Sequence: Synthetic probe
atcaccttgtgttatgctgagaaagttcactttgctggattcaccgccccggcatgtgaa

SEQ ID NO: 19650 - DNA, 60 bp, Artificial Sequence
  Description of Artificial Sequence: Synthetic probe
gagcttatgctacaatgtttgaaatggttcggtgtattatcaccttgtgttatgctgaga

SEQ ID NO: 19651 - DNA, 60 bp, Artificial Sequence
  Description of Artificial Sequence: Synthetic probe
tttaggcagtttcttagatatcatcctgaaaggaccggagctcagcgaagatgaggatga

SEQ ID NO: 19652 - DNA, 60 bp, Artificial Sequence
  Description of Artificial Sequence: Synthetic probe
gtctttaaaactaagctaattcgtgatcagcaaatcggcagaattggggatcattattac

SEQ ID NO: 19653 - DNA, 60 bp, Artificial Sequence
  Description of Artificial Sequence: Synthetic probe
cgtgtagcgtaatagatgttcgcgcttcagagttgatcggttgctcacccttcagaactg

SEQ ID NO: 19654 - DNA, 60 bp, Artificial Sequence
  Description of Artificial Sequence: Synthetic probe
acgtgatttcccaacgcgcgaccgtaacatcgtggaagcgcgtgtgaaaaggtcgggtga

SEQ ID NO: 19655 - DNA, 60 bp, Artificial Sequence
  Description of Artificial Sequence: Synthetic probe
agagattaggtatgtgcaacaattattcgggaaggttccatctggcgaattcccactgca

SEQ ID NO: 19656 - DNA, 60 bp, Artificial Sequence
  Description of Artificial Sequence: Synthetic probe
cgatggccatacagcaatatctaagagttggatatttagaagagattaggtatgtgcaac

SEQ ID NO: 19657 - DNA, 60 bp, Artificial Sequence
  Description of Artificial Sequence: Synthetic probe
gagaggcagatcaacacttgcccttatactggatacaaaggaggaattttccaagtgatg

SEQ ID NO: 19658 - DNA, 60 bp, Artificial Sequence
  Description of Artificial Sequence: Synthetic probe
ggttagaggacagcatcatcaaattaagcgagaagttgagaggcagatcaacacttgccc

SEQ ID NO: 19659 - DNA, 60 bp, Artificial Sequence
  Description of Artificial Sequence: Synthetic probe
cagatcgcgtactatttctacaatccagatgcagctgacgattggatagatccaaattta

SEQ ID NO: 19660 - DNA, 60 bp, Artificial Sequence
  Description of Artificial Sequence: Synthetic probe
ccataaaagaaggtcaaattgtgaacccaacgttcatctccaggtatcgccagatcgcgt

SEQ ID NO: 19661 - DNA, 60 bp, Artificial Sequence
  Description of Artificial Sequence: Synthetic probe
gagggttagattagacgattcgctttcggccattccctatatttatgttcccataaaaga

SEQ ID NO: 19662 - DNA, 60 bp, Artificial Sequence
  Description of Artificial Sequence: Synthetic probe
agtggaatgatggaggaggctattaagcaatctgctttgattaactcggagagggttaga

SEQ ID NO: 19663 - DNA, 60 bp, Artificial Sequence
  Description of Artificial Sequence: Synthetic probe
aaggcaagataaaacgatgcggtgcacagctacttgaagactaccgcaaaagtggaatga

SEQ ID NO: 19664 - DNA, 60 bp, Artificial Sequence
  Description of Artificial Sequence: Synthetic probe
ccggctgatagaattggcaaaagaggcgatgtatgatcgagagaccgtttggctgcagtg

SEQ ID NO: 19665 - DNA, 60 bp, Artificial Sequence
  Description of Artificial Sequence: Synthetic probe
cggggtgcaactgctcgaggattaccgcaagagtgggatgatggatgaggccgtgaagca

SEQ ID NO: 19666 - DNA, 60 bp, Artificial Sequence
  Description of Artificial Sequence: Synthetic probe
gagcttaatcatattgccggtcggcgtttaggcgcttgtgaccgcgtggttaggggggga

SEQ ID NO: 19667 - DNA, 60 bp, Artificial Sequence
  Description of Artificial Sequence: Synthetic probe
cgtacgagggatattccggataatgcgctcgcggttagcgttctgtcaaagaatcgcgcg

SEQ ID NO: 19668 - DNA, 60 bp, Artificial Sequence
  Description of Artificial Sequence: Synthetic probe
gcgagcatgtgctacgcttcaagaagcaagaatcgtattggaagctaatgtgatggagat

SEQ ID NO: 19669 - DNA, 60 bp, Artificial Sequence
  Description of Artificial Sequence: Synthetic probe
cgcgtgtgcaggttaattatggccctacgggggagccgttggatttccagatcggcagaa

SEQ ID NO: 19670 - DNA, 60 bp, Artificial Sequence
  Description of Artificial Sequence: Synthetic probe
ttgagacagattaaacgacatgtaaatgaacaaatcctgccaaagttgaaaagtgaccta

SEQ ID NO: 19671 - DNA, 60 bp, Artificial Sequence
  Description of Artificial Sequence: Synthetic probe
cagatcatcgaagtagaacgcagtctccagaaagagctggggatttcgcgtgagggagtg

SEQ ID NO: 19672 - DNA, 60 bp, Artificial Sequence
  Description of Artificial Sequence: Synthetic probe
cgaccccttatttagaaggagatgtactgtcgagtgattcaggaccgttgttatcagtgt

SEQ ID NO: 19673 - DNA, 60 bp, Artificial Sequence
  Description of Artificial Sequence: Synthetic probe
ggaggttatgaagaagcaatcatataatgatgcggtgaggatgagtttcacagagttttc

SEQ ID NO: 19674 - DNA, 60 bp, Artificial Sequence
  Description of Artificial Sequence: Synthetic probe
cgttcagacatatcgtaatgcagtcaagagatcgagtcttacgagtagatacctactatg

SEQ ID NO: 19675 - DNA, 51 bp, Artificial Sequence
  Description of Artificial Sequence: Synthetic probe
tttaaaagccttaacccgatgctcggcgttgtcaatttgggagcaactttt

SEQ ID NO: 19676 - DNA, 60 bp, Artificial Sequence
  Description of Artificial Sequence: Synthetic probe
aaatcttgaactattgcgaagtttgacaacaattgaagcgttccacgtacttcaaggcgc

SEQ ID NO: 19677 - DNA, 60 bp, Artificial Sequence
  Description of Artificial Sequence: Synthetic probe
ccaacatttatatcaagatatcgccaaattgcatactatttctacaatccggatgcagct

SEQ ID NO: 19678 - DNA, 60 bp, Artificial Sequence
  Description of Artificial Sequence: Synthetic probe
tcgaatgtttcaggaacgcagatgcatacgaaaaggttggtgagatcgaaaacggtacac

SEQ ID NO: 19679 - DNA, 60 bp, Artificial Sequence
  Description of Artificial Sequence: Synthetic probe
ctggacgtacgttaaccgaggcgtataaagagtttttgaatatggcgatttcgaatgttt

SEQ ID NO: 19680 - DNA, 60 bp, Artificial Sequence
  Description of Artificial Sequence: Synthetic probe
tcttttttcactgcatctcgcatcaccatgcaaacgagtcattcttcttagggtttgatc

SEQ ID NO: 19681 - DNA, 60 bp, Artificial Sequence
  Description of Artificial Sequence: Synthetic probe
gatgaaatttaaaattccgagagcgcagcagccacagattcatgtctacagcgcgccttg

SEQ ID NO: 19682 - DNA, 60 bp, Artificial Sequence
  Description of Artificial Sequence: Synthetic probe
tatggatgaagagaaagaaatttgcggaaccgaggataggactatacaccctaaagttat

SEQ ID NO: 19683 - DNA, 60 bp, Artificial Sequence
  Description of Artificial Sequence: Synthetic probe
aaggagttaatgcatataaaagatgagatcttacctcgatttaaaaaagctatggatgaa

SEQ ID NO: 19684 - DNA, 60 bp, Artificial Sequence
  Description of Artificial Sequence: Synthetic probe
cattagcggttagcatcttatcgaaaaaccgtgccatccaggaaaatcacaaggagttaa

SEQ ID NO: 19685 - DNA, 60 bp, Artificial Sequence
  Description of Artificial Sequence: Synthetic probe
cgtagtatccactattttggagtatcgtacgaaggagattccagataatgcattagcggt

SEQ ID NO: 19686 - DNA, 60 bp, Artificial Sequence
  Description of Artificial Sequence: Synthetic probe
ttaagtggaattgatttaacgcacctacgtacaccaaggattgagccaagcgtagtatcc

SEQ ID NO: 19687 - DNA, 60 bp, Artificial Sequence
  Description of Artificial Sequence: Synthetic probe
gaggcggcatcggaagaggtaccattaataggtgctggaatggcaacggcggtagctact

SEQ ID NO: 19688 - DNA, 60 bp, Artificial Sequence
  Description of Artificial Sequence: Synthetic probe
tgcaggaagaggccatacaagagatcgcggggatgaccgccgatgtattagaggcggcat

SEQ ID NO: 19689 - DNA, 60 bp, Artificial Sequence
  Description of Artificial Sequence: Synthetic probe
gcgcttaaaagtgcgatagaagttgaaagagatggtatgcaggaagaggccatacaagag

SEQ ID NO: 19690 - DNA, 60 bp, Artificial Sequence
  Description of Artificial Sequence: Synthetic probe
gtgagaggacgcacgcggagacggtgatggtaaaggaataccgaaataagattgatgcgc

SEQ ID NO: 19691 - DNA, 60 bp, Artificial Sequence
  Description of Artificial Sequence: Synthetic probe
aggcggtggcctcttacaataaaatcttaacggaagaagatctacagatgcggcgattgg

SEQ ID NO: 19692 - DNA, 60 bp, Artificial Sequence
  Description of Artificial Sequence: Synthetic probe
gtatgcaggttaagctgaaagagctggaggatgaacaacgcaatgaacttgtgcgactta

SEQ ID NO: 19693 - DNA, 60 bp, Artificial Sequence
  Description of Artificial Sequence: Synthetic probe
acagtacgatcgggaaagcagctgagaggttcgcagagagtgagatcggttcagccgcga

SEQ ID NO: 19694 - DNA, 60 bp, Artificial Sequence
  Description of Artificial Sequence: Synthetic probe
cagataacaaatcatacggggaatcattgtgatttgtatcctgacgatgtagagatcacg

SEQ ID NO: 19695 - DNA, 60 bp, Artificial Sequence
  Description of Artificial Sequence: Synthetic probe
ggtagagtatggtggtcaaatccttatccatgtttacgtggcgcgttgatcgcgtctgaa

SEQ ID NO: 19696 - DNA, 58 bp, Artificial Sequence
  Description of Artificial Sequence: Synthetic probe
tcgatcacctctaaagggtccagggtaccttcttgacgtagggcgatttcacacttac

SEQ ID NO: 19697 - DNA, 60 bp, Artificial Sequence
  Description of Artificial Sequence: Synthetic probe
gagaacggaaacgtagctacacgagacgttgacgtattcataggcgcctgttcggaacca

SEQ ID NO: 19698 - DNA, 60 bp, Artificial Sequence
  Description of Artificial Sequence: Synthetic probe
accgcggatgttttagaagcagcatcggaagaagtccccctgattggagcgggcatggct

SEQ ID NO: 19699 - DNA, 60 bp, Artificial Sequence
  Description of Artificial Sequence: Synthetic probe
ttaaacgccatgtgaacgagcagattctacccaaattaaaaagtgatctaagtggattga

SEQ ID NO: 19700 - DNA, 50 bp, Artificial Sequence
  Description of Artificial Sequence: Synthetic probe
gactcccactgctgtctaacgggggagggtatgcggcgctacacacttac

SEQ ID NO: 19701 - DNA, 60 bp, Artificial Sequence
  Description of Artificial Sequence: Synthetic probe
ccgcagtggtttaagagtttaaatcctatgcttggagtggtaaatctaggtgcgactttc

SEQ ID NO: 19702 - DNA, 60 bp, Artificial Sequence
  Description of Artificial Sequence: Synthetic probe
aattatggacattacacaatcgctcaaaatgggcaccaagctggcagcgccgactgtgta

SEQ ID NO: 19703 - DNA, 60 bp, Artificial Sequence
  Description of Artificial Sequence: Synthetic probe
aattatggacattacacaatcgctcaaaatgggtactaagctggctgcgccgactgtgta

SEQ ID NO: 19704 - DNA, 60 bp, Artificial Sequence
  Description of Artificial Sequence: Synthetic probe
ggttatgctaccttcgttgcaaccatcacttaaactggcgctggaagaagaagcttgggc

SEQ ID NO: 19705 - DNA, 60 bp, Artificial Sequence
  Description of Artificial Sequence: Synthetic probe
tgggttatgctaccttcgttgcaaccatcacttaaactggcgctggaagaagaagcttgg

SEQ ID NO: 19706 - DNA, 60 bp, Artificial Sequence
  Description of Artificial Sequence: Synthetic probe
agagatatgatgagatgggttatgctaccttcgttgcaaccatcacttaaactggcgctg

SEQ ID NO: 19707 - DNA, 60 bp, Artificial Sequence
  Description of Artificial Sequence: Synthetic probe
caacgcagcgctctgcttaggctattctgttttgtgtgctacggatatgcgccgcgtgca

SEQ ID NO: 19708 - DNA, 60 bp, Artificial Sequence
  Description of Artificial Sequence: Synthetic probe
agggaagatgaagcggtgcggggtgcaactgctcgaggattaccgcaaaagtggaatgat

SEQ ID NO: 19709 - DNA, 60 bp, Artificial Sequence
  Description of Artificial Sequence: Synthetic probe
gtcgaagggaagatgaagcggtgcggggtgcaactgctcgaggattaccgcaaaagtggg

SEQ ID NO: 19710 - DNA, 60 bp, Artificial Sequence
  Description of Artificial Sequence: Synthetic probe
cgctagatggtttcgaattaccattaacttaagatcagtaggtggagtggcgccccgagg

SEQ ID NO: 19711 - DNA, 60 bp, Artificial Sequence
  Description of Artificial Sequence: Synthetic probe
ccatggcatgtgagaaacgatctaattgcagcgctaagggaatacaaacgaaaaatggga

SEQ ID NO: 19712 - DNA, 54 bp, Artificial Sequence
  Description of Artificial Sequence: Synthetic probe
ccatggcatgtgagaaacgatctaattgcagcgctaagggaatacaaacgaaaa

SEQ ID NO: 19713 - DNA, 60 bp, Artificial Sequence
  Description of Artificial Sequence: Synthetic probe
ccatggcatgtgcgaaacgatctaattgcagcgctaagggaatacaaacggaaaatgggg

SEQ ID NO: 19714 - DNA, 60 bp, Artificial Sequence
  Description of Artificial Sequence: Synthetic probe
gtctgcggcggaagtaatagaatggaaggagcagatggccgaacgtccatggcatgtgcg

SEQ ID NO: 19715 - DNA, 60 bp, Artificial Sequence
  Description of Artificial Sequence: Synthetic probe
gtctgcggcggaagtaatagaatggaaggagcaaatggccgagcgcccatggcatgtgag

SEQ ID NO: 19716 - DNA, 60 bp, Artificial Sequence
  Description of Artificial Sequence: Synthetic probe
agaggtctgcggcggaagtaatagaatggaaggagcaaatggccgagcgcccatggcatg

SEQ ID NO: 19717 - DNA, 60 bp, Artificial Sequence
  Description of Artificial Sequence: Synthetic probe
agaggtctgcggcggaagtaatagaatggaaggagcagatggccgaacgtccatggcatg

SEQ ID NO: 19718 - DNA, 60 bp, Artificial Sequence
  Description of Artificial Sequence: Synthetic probe
ggcatggactaagaaccgctatattaaataggactactctgccaaatatgttaccgccta

SEQ ID NO: 19719 - DNA, 60 bp, Artificial Sequence
  Description of Artificial Sequence: Synthetic probe
ggccgcattgcaaatccataatcctacacagcagaatgcaatggtacagatacaggtagt

SEQ ID NO: 19720 - DNA, 60 bp, Artificial Sequence
  Description of Artificial Sequence: Synthetic probe
caggccgcattgcaaatccataatcctacacagcagaatgcaatggtacagatacaggta

SEQ ID NO: 19721 - DNA, 60 bp, Artificial Sequence
  Description of Artificial Sequence: Synthetic probe
gtattgcgattaacaggtataatggattaacacttcgtggagttacaatgcgcccgacgt

SEQ ID NO: 19722 - DNA, 60 bp, Artificial Sequence
  Description of Artificial Sequence: Synthetic probe
tggttgggcgacgatcgatgttgagtatagagaacccgcaccctacgtacatgctcagcg

SEQ ID NO: 19723 - DNA, 60 bp, Artificial Sequence
  Description of Artificial Sequence: Synthetic probe
ttgacggctcattggcacgcactgggggtggctcagatggccgtaggacgcacgctaacc

SEQ ID NO: 19724 - DNA, 56 bp, Artificial Sequence
  Description of Artificial Sequence: Synthetic probe
ctttgaaatttggatgtaaggttttgggggaccgtttagacgtaccactcttctta

SEQ ID NO: 19725 - DNA, 60 bp, Artificial Sequence
  Description of Artificial Sequence: Synthetic probe
attgcggggatgaccgcagatgtgttagaggcggcatcggaggaggttccgctgattggt

SEQ ID NO: 19726 - DNA, 60 bp, Artificial Sequence
  Description of Artificial Sequence: Synthetic probe
atcgcggggatgaccgcagatgtgttagaggcggcatcggaggaggttccgctgattggt

SEQ ID NO: 19727 - DNA, 60 bp, Artificial Sequence
  Description of Artificial Sequence: Synthetic probe
cccttagcgaagatgggtaaagtcatacggtccttaagccgatttggcaagaaggtgggc

SEQ ID NO: 19728 - DNA, 53 bp, Artificial Sequence
  Description of Artificial Sequence: Synthetic probe
ccccttagcgaagatgggtaaagtcatacggtccttaaaccgatttggcaaaa

SEQ ID NO: 19729 - DNA, 60 bp, Artificial Sequence
  Description of Artificial Sequence: Synthetic probe
aaagtgcgcccttagcgaagatgggtaaagtcatacggtccttaagccgatttggcaaaa

SEQ ID NO: 19730 - DNA, 60 bp, Artificial Sequence
  Description of Artificial Sequence: Synthetic probe
aaagtgcacccttagcgaagatgggtaaagtcatacggtccttaagccgatttggcaaaa

SEQ ID NO: 19731 - DNA, 60 bp, Artificial Sequence
  Description of Artificial Sequence: Synthetic probe
gttaaaaagtgcacccttagcgaagatgggtaaagtcatacggtccttaagccgatttgg

SEQ ID NO: 19732 - DNA, 60 bp, Artificial Sequence
  Description of Artificial Sequence: Synthetic probe
gttaaaaagtgcgcccttagcgaagatgggtaaagtcatacggtccttaagccgatttgg

SEQ ID NO: 19733 - DNA, 60 bp, Artificial Sequence
  Description of Artificial Sequence: Synthetic probe
gttaaaaagtgcccccttagcgaagatgggtaaagtcatacggtccttaaaccgatttgg

SEQ ID NO: 19734 - DNA, 60 bp, Artificial Sequence
  Description of Artificial Sequence: Synthetic probe
cagcgcgttgctcaggttgttctgcttcgtgtgttacggatatgcgccgcgtgtggatgg

SEQ ID NO: 19735 - DNA, 60 bp, Artificial Sequence
  Description of Artificial Sequence: Synthetic probe
attcacggcgtaaacccaatgcctgggccgctcacacgtgctattgcacgcaccgcctat

SEQ ID NO: 19736 - DNA, 60 bp, Artificial Sequence
  Description of Artificial Sequence: Synthetic probe
agtgttctcctactcgcgaagatggggaagataattaaatcgctaagtagatttggaaaa

SEQ ID NO: 19737 - DNA, 60 bp, Artificial Sequence
  Description of Artificial Sequence: Synthetic probe
gttaaaaagtgttctcctactcgcgaagatggggaagataattaaatcgctaagtagatt

SEQ ID NO: 19738 - DNA, 60 bp, Artificial Sequence
  Description of Artificial Sequence: Synthetic probe
gcggattgcatcgagttaatgcgttatcatatgtctcagtacatggatttgagagtatca

SEQ ID NO: 19739 - DNA, 60 bp, Artificial Sequence
  Description of Artificial Sequence: Synthetic probe
aggatgaaggcaacccattactatacgatttagagaaggacataaagttggatcgcgttt

SEQ ID NO: 19740 - DNA, 60 bp, Artificial Sequence
  Description of Artificial Sequence: Synthetic probe
tgaaggatgaaggtaacccattactatacgatttagagaaggacattaagttggatcgcg

SEQ ID NO: 19741 - DNA, 59 bp, Artificial Sequence
  Description of Artificial Sequence: Synthetic probe
aatctgtttgatttggaggcggaacctggaacaaaagtgttgcattgggagtatgagct

SEQ ID NO: 19742 - DNA, 60 bp, Artificial Sequence
  Description of Artificial Sequence: Synthetic probe
gagattagtagggcgttatgattatgtgattgagttggcgaggccagaaggcgatgaatg

SEQ ID NO: 19743 - DNA, 60 bp, Artificial Sequence
  Description of Artificial Sequence: Synthetic probe
aagattggtggggcgttatgattatgtgattgagttggcgaggccagagggcgatgagtg

SEQ ID NO: 19744 - DNA, 60 bp, Artificial Sequence
  Description of Artificial Sequence: Synthetic probe
cgaacgattcgataagagattagtagggcgttatgattatgtgattgagttggcgaggcc

SEQ ID NO: 19745 - DNA, 60 bp, Artificial Sequence
  Description of Artificial Sequence: Synthetic probe
gcgttggcggagtagacatgcgggcgggacgtattatagcgtgggatggacaaactgctc

SEQ ID NO: 19746 - DNA, 60 bp, Artificial Sequence
  Description of Artificial Sequence: Synthetic probe
gcgtgactgttagcgttggcggagttgacatgcgggcgggacgtattatagcgtgggatg

SEQ ID NO: 19747 - DNA, 60 bp, Artificial Sequence
  Description of Artificial Sequence: Synthetic probe
agaagagtggggcgcatgcaaaggctgctgagagagggagacgtaaacaagggaagaagc

SEQ ID NO: 19748 - DNA, 60 bp, Artificial Sequence
  Description of Artificial Sequence: Synthetic probe
atctgcgacgaaaagagaagagtggggcgcatgcaaaggctgctgagagagggagacgta

SEQ ID NO: 19749 - DNA, 60 bp, Artificial Sequence
  Description of Artificial Sequence: Synthetic probe
atctgcgacgaaaagagaagagtggggcgcatgcaaaggctgctgagagagggaggcgta

SEQ ID NO: 19750 - DNA, 60 bp, Artificial Sequence
  Description of Artificial Sequence: Synthetic probe
gcgtggcgttcaaattaaatggtacatcagctgaaatacctcaatggtttaagagtttga

SEQ ID NO: 19751 - DNA, 60 bp, Artificial Sequence
  Description of Artificial Sequence: Synthetic probe
atatgagcgtggcgttcaaattaaatggtacatcagctgaaatacctcaatggtttaaga

SEQ ID NO: 19752 - DNA, 60 bp, Artificial Sequence
  Description of Artificial Sequence: Synthetic probe
cggtttgtacgttgtcgagcgatatgagcgtggcgtttaagttaaatggtacatcagctg

SEQ ID NO: 19753 - DNA, 60 bp, Artificial Sequence
  Description of Artificial Sequence: Synthetic probe
tctgctgacatcggtttgtacgttgtcgagcgatatgagcgtggcgtttaagttaaatgg

SEQ ID NO: 19754 - DNA, 60 bp, Artificial Sequence
  Description of Artificial Sequence: Synthetic probe
caagtgatatgagtgtggcgtttaaacttaatggtacatcagcggagataccgcagtggt

SEQ ID NO: 19755 - DNA, 60 bp, Artificial Sequence
  Description of Artificial Sequence: Synthetic probe
atggaggagtttgtcattcctgtgttttcagagagggagatcccttacgctctgattaat

SEQ ID NO: 19756 - DNA, 60 bp, Artificial Sequence
  Description of Artificial Sequence: Synthetic probe
agaagttctgactgactttaggagacaggacacgatctgggttttagctttacagctacc

SEQ ID NO: 19757 - DNA, 60 bp, Artificial Sequence
  Description of Artificial Sequence: Synthetic probe
gcggctgtggttgctctgttgacatcagtttgcacgttatcgagtgatatgagcgtggcg

SEQ ID NO: 19758 - DNA, 60 bp, Artificial Sequence
  Description of Artificial Sequence: Synthetic probe
tactgatagcggctgtggttgctctgttgacatcagtttgcacgttatcgagtgatatga

SEQ ID NO: 19759 - DNA, 60 bp, Artificial Sequence
  Description of Artificial Sequence: Synthetic probe
gcgggatagatctaacacaccttcgtacgccgaaaattgagcctagcgtagtctctacaa

SEQ ID NO: 19760 - DNA, 60 bp, Artificial Sequence
  Description of Artificial Sequence: Synthetic probe
aagcgggatagatctaacacaccttcgtacgccgaaaattgagcctagcgtagtctctac

SEQ ID NO: 19761 - DNA, 60 bp, Artificial Sequence
  Description of Artificial Sequence: Synthetic probe
caggatcgcgatggatgagcttggcattccaatttatggacgtaattacccagagcattt

SEQ ID NO: 19762 - DNA, 60 bp, Artificial Sequence
  Description of Artificial Sequence: Synthetic probe
tggtttaagagtttgaatccaatgttgggtgtggtaaatctaggggcaaccttcctgatg

SEQ ID NO: 19763 - DNA, 60 bp, Artificial Sequence
  Description of Artificial Sequence: Synthetic probe
cctcaatggtttaagagtttgaatccaatgttgggtgtggtcaattttggagctaccttc

SEQ ID NO: 19764 - DNA, 60 bp, Artificial Sequence
  Description of Artificial Sequence: Synthetic probe
gaaaatacaacatcagtggggattacgcaaatgccacgagaacttttttggctatctcac

SEQ ID NO: 19765 - DNA, 60 bp, Artificial Sequence
  Description of Artificial Sequence: Synthetic probe
cgaagagctaagtttggttcgtgtggatgatacgatttcacaaccaccaagatatgctcc

SEQ ID NO: 19766 - DNA, 60 bp, Artificial Sequence
  Description of Artificial Sequence: Synthetic probe
gtggaaaaacgccgcgtatgacagaactgagatacgtgcattggagctctgcaagatact

SEQ ID NO: 19767 - DNA, 60 bp, Artificial Sequence
  Description of Artificial Sequence: Synthetic probe
ccccggatccccggggttaaaagagtgttctaccatggaggaattcgtcataccagtgtt

SEQ ID NO: 19768 - DNA, 60 bp, Artificial Sequence
  Description of Artificial Sequence: Synthetic probe
gcaatcatataatgatgcagtgaggatgagtttcacagagttttcgtcaatcccgctaga

SEQ ID NO: 19769 - DNA, 60 bp, Artificial Sequence
  Description of Artificial Sequence: Synthetic probe
gcgaagagcgaaagagggctaaatcagcaaattgatatgattaagaaggaggttatgaag

SEQ ID NO: 19770 - DNA, 60 bp, Artificial Sequence
  Description of Artificial Sequence: Synthetic probe
gtgcgaagagcgaaagagggctaaatcagcaaattgatatgattaagaaggaggttatga

SEQ ID NO: 19771 - DNA, 60 bp, Artificial Sequence
  Description of Artificial Sequence: Synthetic probe
ggagagaattgaagagctgagcctagttcgcgtggatgatacgatttcacaaccaccgag

SEQ ID NO: 19772 - DNA, 60 bp, Artificial Sequence
  Description of Artificial Sequence: Synthetic probe
taatcaggagagaattgaagagctgagcctagttcgcgtggatgatacgatttcacaacc

SEQ ID NO: 19773 - DNA, 60 bp, Artificial Sequence
  Description of Artificial Sequence: Synthetic probe
aatggttgcaatcatgcgtggattcaaagagtgcaccatttggtcaacatcgagatgctt

SEQ ID NO: 19774 - DNA, 60 bp, Artificial Sequence
  Description of Artificial Sequence: Synthetic probe
cgacgatcggaaaagaataataacgagtggaggtcagagtgaatatcatacgaaagcgga

SEQ ID NO: 19775 - DNA, 60 bp, Artificial Sequence
  Description of Artificial Sequence: Synthetic probe
atactgaacaaggcggtgacctcgtataacaaaattcttacggaggaagatctacagatg

SEQ ID NO: 19776 - DNA, 60 bp, Artificial Sequence
  Description of Artificial Sequence: Synthetic probe
atactgaacaaggcggtgacctcgtataacaaaattctcacggaagaggatctacagatg

SEQ ID NO: 19777 - DNA, 60 bp, Artificial Sequence
  Description of Artificial Sequence: Synthetic probe
atactgaacaaggcggtgacctcgtataacaaaattcttacggaagaagatctacagatg

SEQ ID NO: 19778 - DNA, 60 bp, Artificial Sequence
  Description of Artificial Sequence: Synthetic probe
gatatactgaacaaggcggtgacctcgtataacaaaattcttacggaggaagatctacag

SEQ ID NO: 19779 - DNA, 60 bp, Artificial Sequence
  Description of Artificial Sequence: Synthetic probe
gagaagcagtttgatatactgaacaaggcggtgacctcgtataacaaaattctcacggaa

SEQ ID NO: 19780 - DNA, 60 bp, Artificial Sequence
  Description of Artificial Sequence: Synthetic probe
gagaagcagtttgatatactgaacaaggcggtgacctcgtataacaaaattcttacggag

SEQ ID NO: 19781 - DNA, 60 bp, Artificial Sequence
  Description of Artificial Sequence: Synthetic probe
gagaagcagtttgatatactgaacaaggcggtgacctcgtataacaaaattcttacggaa

SEQ ID NO: 19782 - DNA, 60 bp, Artificial Sequence
  Description of Artificial Sequence: Synthetic probe
gccgatttggcaaaaaggtgggcaacgcgttaacttctaataccgcaaaaaagatctata

SEQ ID NO: 19783 - DNA, 60 bp, Artificial Sequence
  Description of Artificial Sequence: Synthetic probe
atgccttggccgctcacagctgctattgcacgcgccgcctatgtgtagtccacttagcac

SEQ ID NO: 19784 - DNA, 60 bp, Artificial Sequence
  Description of Artificial Sequence: Synthetic probe
cagcgggcggtagatttacgaatttaacacagaatatggcgagacagctcgatatagcct

SEQ ID NO: 19785 - DNA, 60 bp, Artificial Sequence
  Description of Artificial Sequence: Synthetic probe
gatgatggtctgtgcaaaaagtgaaagaagcttgaatcagcaaattgatatgattaagaa

SEQ ID NO: 19786 - DNA, 60 bp, Artificial Sequence
  Description of Artificial Sequence: Synthetic probe
gatgatggtttgtgcaaaaagtgaaagaagcttgaatcagcaaattgatatgattaagaa

SEQ ID NO: 19787 - DNA, 60 bp, Artificial Sequence
  Description of Artificial Sequence: Synthetic probe
gatgatggtttgtgcgaaaagtgaaagaagcttgaatcagcaaattgatatgattaagaa

SEQ ID NO: 19788 - DNA, 60 bp, Artificial Sequence
  Description of Artificial Sequence: Synthetic probe
tgaagaggtatgagttgcagtgtgtgggtgcgtgtgagcgtgttgcttttgtctctaagg

SEQ ID NO: 19789 - DNA, 60 bp, Artificial Sequence
  Description of Artificial Sequence: Synthetic probe
gcgacaccctcagtctgggacaaagacagtcagctgtattcgaacatatggctcaacaag

SEQ ID NO: 19790 - DNA, 60 bp, Artificial Sequence
  Description of Artificial Sequence: Synthetic probe
cgaacccttatccatgtttgcgtggtgcgctaattgctgctgagtgtgagctcggcgatg

SEQ ID NO: 19791 - DNA, 60 bp, Artificial Sequence
  Description of Artificial Sequence: Synthetic probe
tgtttggagaacgaacccttatccatgtttgcgtggtgcgctaattgctgctgagtgtga

SEQ ID NO: 19792 - DNA, 60 bp, Artificial Sequence
  Description of Artificial Sequence: Synthetic probe
cgcgtatgacagaactaagatacgtgcattggagctctgcaagatactttcggcgatcgg

SEQ ID NO: 19793 - DNA, 60 bp, Artificial Sequence
  Description of Artificial Sequence: Synthetic probe
aatcagatcaaacgtgaggttgagaggcaaattaatacatgtccctacactggatacaaa

SEQ ID NO: 19794 - DNA, 60 bp, Artificial Sequence
  Description of Artificial Sequence: Synthetic probe
tcagtgttggtggagttgacatgagggcgggacgcattatagcgtgggatggacaggccg

SEQ ID NO: 19795 - DNA, 60 bp, Artificial Sequence
  Description of Artificial Sequence: Synthetic probe
ttagtgttggtggggtagacatgagggcgggacgcattatagcgtgggatggacaggccg

SEQ ID NO: 19796 - DNA, 60 bp, Artificial Sequence
  Description of Artificial Sequence: Synthetic probe
tgggtaagatttggtggtgttttacgaacggttcgcgttaaattctatgacgcacgacct

SEQ ID NO: 19797 - DNA, 60 bp, Artificial Sequence
  Description of Artificial Sequence: Synthetic probe
gaccagagtttgcgattcacggcgtaaatccgatgccagggccgctcacacgtgctattg

SEQ ID NO: 19798 - DNA, 60 bp, Artificial Sequence
  Description of Artificial Sequence: Synthetic probe
gttaagaccagagtttgcgattcacggcgtaaatccgatgccagggccgctcacacgtgc

SEQ ID NO: 19799 - DNA, 60 bp, Artificial Sequence
  Description of Artificial Sequence: Synthetic probe
tgtttacactgttttaaggccagagtttgcgattcacggcgtaaatccgatgccagggcc

SEQ ID NO: 19800 - DNA, 60 bp, Artificial Sequence
  Description of Artificial Sequence: Synthetic probe
caccctttcaagcgatatgagtgtagcttttaagataaatggaactaagacagaagtgcc

SEQ ID NO: 19801 - DNA, 51 bp, Artificial Sequence
  Description of Artificial Sequence: Synthetic probe
cgctgaagaggtcagatatgtgcagcagctttttgggagggttccaacagg

SEQ ID NO: 19802 - DNA, 60 bp, Artificial Sequence
  Description of Artificial Sequence: Synthetic probe
tttcccaacattcgcacgcttgatttcgaatgcgcggaaaccgacttatgtgaaagatct

SEQ ID NO: 19803 - DNA, 60 bp, Artificial Sequence
  Description of Artificial Sequence: Synthetic probe
ttatttcccaacattcgcacgcttgatttcgaatgcgcggaaaccgacttatgtgaaaga

SEQ ID NO: 19804 - DNA, 60 bp, Artificial Sequence
  Description of Artificial Sequence: Synthetic probe
gagatggaatgcaggaggaggcgatccaggagattgctggaatgactgccgacgtcttgg

SEQ ID NO: 19805 - DNA, 60 bp, Artificial Sequence
  Description of Artificial Sequence: Synthetic probe
gaacgagacggaatgcaggaggaggcgatccaggagattgctggaatgaccgctgacgtc

SEQ ID NO: 19806 - DNA, 60 bp, Artificial Sequence
  Description of Artificial Sequence: Synthetic probe
catttcgctgggtctgcagcgcctgcgtgtgaaagtggagaagtaatcaacctcgctgca

SEQ ID NO: 19807 - DNA, 60 bp, Artificial Sequence
  Description of Artificial Sequence: Synthetic probe
cgctttgctcaggctattttgtttcgtgtgttatggatatgcaccacgcgcggatgggac

SEQ ID NO: 19808 - DNA, 60 bp, Artificial Sequence
  Description of Artificial Sequence: Synthetic probe
cggagcggaggcattggtcacaaccgcgattcacattcatcgctggatcaggggatccgg

SEQ ID NO: 19809 - DNA, 60 bp, Artificial Sequence
  Description of Artificial Sequence: Synthetic probe
gcatctgagctgactgggtgctcaccgtttaagatggtgaagatcgaagagcacgtagga

SEQ ID NO: 19810 - DNA, 60 bp, Artificial Sequence
  Description of Artificial Sequence: Synthetic probe
cgcagtattgtggaggcgcgggtaaggagatcaggcgatgagaactggcaaagctggcta

SEQ ID NO: 19811 - DNA, 60 bp, Artificial Sequence
  Description of Artificial Sequence: Synthetic probe
tgaatttccactacaccagatgatgctaatgagacgtgatttcccaacgcgcgatcgcag

SEQ ID NO: 19812 - DNA, 60 bp, Artificial Sequence
  Description of Artificial Sequence: Synthetic probe
cgtggacagcacaatcaaattcaacgtgaggttgagagacaaattaacacatgcccttac

SEQ ID NO: 19813 - DNA, 60 bp, Artificial Sequence
  Description of Artificial Sequence: Synthetic probe
gagttagactggatgattcactttccgcaatgccttacatttatgtgccaatcaaggaag

SEQ ID NO: 19814 - DNA, 60 bp, Artificial Sequence
  Description of Artificial Sequence: Synthetic probe
ggcttcaatgtttcaagagcttttctcaaccatacgaggaggatgtcgaagggaagatga

SEQ ID NO: 19815 - DNA, 60 bp, Artificial Sequence
  Description of Artificial Sequence: Synthetic probe
gagagagcgatgattgcagcaactgatgcagaagagccagcgaaagcatacaaattggtt

SEQ ID NO: 19816 - DNA, 60 bp, Artificial Sequence
  Description of Artificial Sequence: Synthetic probe
tgtttacactgttttaaggccagagtttgcgattcacggcgtaaatccgatgcctgggcc

SEQ ID NO: 19817 - DNA, 60 bp, Artificial Sequence
  Description of Artificial Sequence: Synthetic probe
cggagaagtatatatttagtaagataaacctatttgattacgaagctggtccatcgagca

SEQ ID NO: 19818 - DNA, 60 bp, Artificial Sequence
  Description of Artificial Sequence: Synthetic probe
aaacggagaagtatatatttagtaagataaacctatttgattacgaagctggtccatcga

SEQ ID NO: 19819 - DNA, 55 bp, Artificial Sequence
  Description of Artificial Sequence: Synthetic probe
caattgaggacgcagagaaagcatgtttacatacgagaggtcaattatgtaatca

SEQ ID NO: 19820 - DNA, 60 bp, Artificial Sequence
  Description of Artificial Sequence: Synthetic probe
gcttctctcaaccatacgaagaagatgttgaagggaagatgaagcggtgcggggtgcaac

SEQ ID NO: 19821 - DNA, 60 bp, Artificial Sequence
  Description of Artificial Sequence: Synthetic probe
gatgttacgtatgaattccccacattggatgattcagcttacaagattgagggaacgttg

SEQ ID NO: 19822 - DNA, 60 bp, Artificial Sequence
  Description of Artificial Sequence: Synthetic probe
agacgatagtgatgttacgtatgaattccccacattggatgattcagcttacaagattga

SEQ ID NO: 19823 - DNA, 53 bp, Artificial Sequence
  Description of Artificial Sequence: Synthetic probe
ccagctcagattatcgaggtggaacgcagtctccagaaagagttggggatttc

SEQ ID NO: 19824 - DNA, 51 bp, Artificial Sequence
  Description of Artificial Sequence: Synthetic probe
gaattcaatattaaaatgcgtatgcgtgaagaagacatctcggcgttggaa

SEQ ID NO: 19825 - DNA, 52 bp, Artificial Sequence
  Description of Artificial Sequence: Synthetic probe
aaatcacatccctttagggatgcaagttatggctgacttcgtaaaccgtttc

SEQ ID NO: 19826 - DNA, 60 bp, Artificial Sequence
  Description of Artificial Sequence: Synthetic probe
tagaattaaagcatatccccttagggatgcaagttatggctgacttcgtaaaccgttttg

SEQ ID NO: 19827 - DNA, 60 bp, Artificial Sequence
  Description of Artificial Sequence: Synthetic probe
ctaggtgcgactttcataatgatggtttgtgcgaagagcgaaagagggttaaatcagcag

SEQ ID NO: 19828 - DNA, 60 bp, Artificial Sequence
  Description of Artificial Sequence: Synthetic probe
ggtatgttcctataacgcacccgtcaaaatgtttagttgcctttgaagtggcggatgacg

SEQ ID NO: 19829 - DNA, 60 bp, Artificial Sequence
  Description of Artificial Sequence: Synthetic probe
ttgttatggtatgttcctataacgcacccgtcaaaatgtttagttgcctttgaggtggcg

SEQ ID NO: 19830 - DNA, 60 bp, Artificial Sequence
  Description of Artificial Sequence: Synthetic probe
gcgcttgctatatgaaacacacttagcgtctttatgtggtgggtattcggatgggttgtt

SEQ ID NO: 19831 - DNA, 60 bp, Artificial Sequence
  Description of Artificial Sequence: Synthetic probe
cgaaacgcttgctatatgaaacacacttagcgtctttatgtggagggtattcagatgggt

SEQ ID NO: 19832 - DNA, 60 bp, Artificial Sequence
  Description of Artificial Sequence: Synthetic probe
gcgcaacgtggtgacgacgaagcgcttgctatatgaaacacacttagcgtctttatgtgg

SEQ ID NO: 19833 - DNA, 60 bp, Artificial Sequence
  Description of Artificial Sequence: Synthetic probe
gatgtgcagccgctcaaggttgataccgcgcacacgagaacgcgagtgagccatgcgtta

SEQ ID NO: 19834 - DNA, 60 bp, Artificial Sequence
  Description of Artificial Sequence: Synthetic probe
gttttacagagttttcgtcaatcccgttggatggtttcgaaatgccattaacctgaggac

SEQ ID NO: 19835 - DNA, 60 bp, Artificial Sequence
  Description of Artificial Sequence: Synthetic probe
gttttacagagttctcgtcaatcccgttggatggtttcgaaatgccattaacctgaggac

SEQ ID NO: 19836 - DNA, 60 bp, Artificial Sequence
  Description of Artificial Sequence: Synthetic probe
cactactctactagtggctgctgtggttgcgttactgacatcagtttgcaccctttcaag

SEQ ID NO: 19837 - DNA, 60 bp, Artificial Sequence
  Description of Artificial Sequence: Synthetic probe
cactactctactagtggctgctgtggttgcgttgctgacatcggtttgcaccctttcaag

SEQ ID NO: 19838 - DNA, 51 bp, Artificial Sequence
  Description of Artificial Sequence: Synthetic probe
agactcctactgctgtctaacgggggagggtgcgcgatactacacacttag

SEQ ID NO: 19839 - DNA, 60 bp, Artificial Sequence
  Description of Artificial Sequence: Synthetic probe
gccgattcagctgatcaatttcttaaggatggatgattttgcgaagcattttaacaggta

SEQ ID NO: 19840 - DNA, 60 bp, Artificial Sequence
  Description of Artificial Sequence: Synthetic probe
gatgacttttacagagttctcgtcaatcccgctagatggtttcgaaatgccattaacctg

SEQ ID NO: 19841 - DNA, 60 bp, Artificial Sequence
  Description of Artificial Sequence: Synthetic probe
gatcgaaatgagatgcccgacttgccaggtgtgatgaggtcaaattatgatatccgcgaa

SEQ ID NO: 19842 - DNA, 60 bp, Artificial Sequence
  Description of Artificial Sequence: Synthetic probe
gcgcagatggcggtaggacgcacgctaactgaagcgtataaggagtttcttaacctggcg

SEQ ID NO: 19843 - DNA, 60 bp, Artificial Sequence
  Description of Artificial Sequence: Synthetic probe
ttgggcgcagcgcagatggcggtaggacgcacgctaactgaagcgtataaggagtttctt

SEQ ID NO: 19844 - DNA, 60 bp, Artificial Sequence
  Description of Artificial Sequence: Synthetic probe
ggttcactatgaagatttgacagctcattggcacgcattgggcgcagcgcagatggcggt

SEQ ID NO: 19845 - DNA, 60 bp, Artificial Sequence
  Description of Artificial Sequence: Synthetic probe
agatggtttcgaattaccattaacctaagatcagtaggtagagtggcgccccgaggtttg

SEQ ID NO: 19846 - DNA, 60 bp, Artificial Sequence
  Description of Artificial Sequence: Synthetic probe
gctcgaagattaccgcaaaagtgggatgatggatgaggccgtgaaacaatccgcattggt

SEQ ID NO: 19847 - DNA, 60 bp, Artificial Sequence
  Description of Artificial Sequence: Synthetic probe
tgcggagtgcaactgctcgaagattaccgcaaaagtgggatgatggatgaggccgtgaag

SEQ ID NO: 19848 - DNA, 60 bp, Artificial Sequence
  Description of Artificial Sequence: Synthetic probe
ggacactatcgcagcaagagcgctcaccgtgatgcgggcatgtgctactttacaagaagc

SEQ ID NO: 19849 - DNA, 60 bp, Artificial Sequence
  Description of Artificial Sequence: Synthetic probe
ggacactatcgcagcaagagcgctcaccgtgatgcgggcatgtgccgctttacaagaagc

SEQ ID NO: 19850 - DNA, 60 bp, Artificial Sequence
  Description of Artificial Sequence: Synthetic probe
cgcatcgtacgcggaagcgtttcgtgatgatgtaagattaagacaaattaaacgccatgt

SEQ ID NO: 19851 - DNA, 60 bp, Artificial Sequence
  Description of Artificial Sequence: Synthetic probe
cgcatcgtacgcggaagcgtttcgtgatgatgtaagattgagacaaatcaaacgccatgt

SEQ ID NO: 19852 - DNA, 53 bp, Artificial Sequence
  Description of Artificial Sequence: Synthetic probe
atagctcgcgtgactggggagacttcgacgtggggaccagcgcgtcagcctta

SEQ ID NO: 19853 - DNA, 60 bp, Artificial Sequence
  Description of Artificial Sequence: Synthetic probe
aggaggcatgggccgctgcaaacgatttcgaggatctgatgcttactgatcaagtttata

SEQ ID NO: 19854 - DNA, 60 bp, Artificial Sequence
  Description of Artificial Sequence: Synthetic probe
gtgcgtatgcgactatgttggagatggttcgttgcataataacgttgcactgcgcagaaa

SEQ ID NO: 19855 - DNA, 60 bp, Artificial Sequence
  Description of Artificial Sequence: Synthetic probe
tacggttatgcgccacgcacagatggaacgatgccagactggaataatttggggaatttt

SEQ ID NO: 19856 - DNA, 60 bp, Artificial Sequence
  Description of Artificial Sequence: Synthetic probe
tcatagatggatacgaggctgtgggatttggaatagtcagggatggcaggaaggcgtttt

SEQ ID NO: 19857 - DNA, 60 bp, Artificial Sequence
  Description of Artificial Sequence: Synthetic probe
ggggcggaagctttgacacaaactgcaatacatattcatagatggatacgaggctgtggg

SEQ ID NO: 19858 - DNA, 60 bp, Artificial Sequence
  Description of Artificial Sequence: Synthetic probe
tcacattgctacacaggggcggaagctttgacacaaactgcaatacatattcatagatgg

SEQ ID NO: 19859 - DNA, 60 bp, Artificial Sequence
  Description of Artificial Sequence: Synthetic probe
agttggtccgtgatgagcaggttggaagacaaggagatcattattacacgtcacattgct

SEQ ID NO: 19860 - DNA, 60 bp, Artificial Sequence
  Description of Artificial Sequence: Synthetic probe
ggaccacattggcaacgaaccgattcagaagattaagttggtccgtgatgagcaggttgg

SEQ ID NO: 19861 - DNA, 60 bp, Artificial Sequence
  Description of Artificial Sequence: Synthetic probe
gtgcggctggcggatataactggctgttcaccttttagagaggtaataataagggaccac

SEQ ID NO: 19862 - DNA, 60 bp, Artificial Sequence
  Description of Artificial Sequence: Synthetic probe
gctatcttagacattcaaaacagcaacatacctgcagcgtaattgatgtgcggctggcgg

SEQ ID NO: 19863 - DNA, 60 bp, Artificial Sequence
  Description of Artificial Sequence: Synthetic probe
gtgatttcctaacgcgtgatcagaacctcgtgggggctagagtgcggagacctggagatg

SEQ ID NO: 19864 - DNA, 60 bp, Artificial Sequence
  Description of Artificial Sequence: Synthetic probe
ggttgttccgccaggtgaattcccactgcatcagatgatgctgatgaaacgtgatttcct

SEQ ID NO: 19865 - DNA, 60 bp, Artificial Sequence
  Description of Artificial Sequence: Synthetic probe
agtttagtagacattttaacagatatgtttctatggctgtgcaacgttttttgagagttg

SEQ ID NO: 19866 - DNA, 60 bp, Artificial Sequence
  Description of Artificial Sequence: Synthetic probe
cgacgtgtccctatactggatatagaggcagagttctccaagtaatgttcttaccagttc

SEQ ID NO: 19867 - DNA, 60 bp, Artificial Sequence
  Description of Artificial Sequence: Synthetic probe
tcaggggtgcgcactgccagattaaacgtgaagtggaaagacagatcacgacgtgtccct

SEQ ID NO: 19868 - DNA, 60 bp, Artificial Sequence
  Description of Artificial Sequence: Synthetic probe
caagcttgtttgaaatcaggggtgcgcactgccagattaaacgtgaagtggaaagacaga

SEQ ID NO: 19869 - DNA, 60 bp, Artificial Sequence
  Description of Artificial Sequence: Synthetic probe
aattgcctattttttctataaccccgacgcagccgaggattggattgacccaagcttgtt

SEQ ID NO: 19870 - DNA, 60 bp, Artificial Sequence
  Description of Artificial Sequence: Synthetic probe
gtaaatcaaggacaaattgtaaatcctgcattcatctctagatatcgtcaaattgcctat

SEQ ID NO: 19871 - DNA, 60 bp, Artificial Sequence
  Description of Artificial Sequence: Synthetic probe
gacgattcgctttcagcactgccatacatctatattccggtaaatcaaggacaaattgta

SEQ ID NO: 19872 - DNA, 60 bp, Artificial Sequence
  Description of Artificial Sequence: Synthetic probe
aatgttataaaagtttttctcagccgtaccaagaagacattgaagataaactgaaaaaat

SEQ ID NO: 19873 - DNA, 60 bp, Artificial Sequence
  Description of Artificial Sequence: Synthetic probe
ggctgaattggcagaagaagcgatgtatgacagagaaacagtgtggttacaatgttataa

SEQ ID NO: 19874 - DNA, 60 bp, Artificial Sequence
  Description of Artificial Sequence: Synthetic probe
tcaatggaatgtgtgctaaacagcactttgaaagggcgatcatcgctgtgactgatgcgg

SEQ ID NO: 19875 - DNA, 60 bp, Artificial Sequence
  Description of Artificial Sequence: Synthetic probe
agaactttctttgcgatatctcctcaatggacgtgtagtcatctgaagaggaattgtttt

SEQ ID NO: 19876 - DNA, 60 bp, Artificial Sequence
  Description of Artificial Sequence: Synthetic probe
atggagcgctttttgaggaagtataatatcagtggagattatgccaatgcaataagaact

SEQ ID NO: 19877 - DNA, 60 bp, Artificial Sequence
  Description of Artificial Sequence: Synthetic probe
gcagacggagagattgagagatctgcggcgaaaagagaagagtggggcgcatgcgaaggc

SEQ ID NO: 19878 - DNA, 60 bp, Artificial Sequence
  Description of Artificial Sequence: Synthetic probe
atacacatgacgttgcttatcgctgctgtcgttgcactgttaacatcggtatgtacgctg

SEQ ID NO: 19879 - DNA, 60 bp, Artificial Sequence
  Description of Artificial Sequence: Synthetic probe
atacacatgacgttgcttatcgctgctgtcgtggcgttattaacatcggtgtgtacgcta

SEQ ID NO: 19880 - DNA, 60 bp, Artificial Sequence
  Description of Artificial Sequence: Synthetic probe
gtattagttaggatgccaggacatgtctttggaaatgatgaattaatgacgaagctacta

SEQ ID NO: 19881 - DNA, 60 bp, Artificial Sequence
  Description of Artificial Sequence: Synthetic probe
gcaaagtagtattagttaggatgccaggacatgtctttggaaatgatgaattaatgacga

SEQ ID NO: 19882 - DNA, 60 bp, Artificial Sequence
  Description of Artificial Sequence: Synthetic probe
gcttacacgagcacgggaggggatgtaaagacggagttcctgcatttgatcgatcacctc

SEQ ID NO: 19883 - DNA, 60 bp, Artificial Sequence
  Description of Artificial Sequence: Synthetic probe
agcttacacgagcacgggaggggatgtaaagacggagttcctgcatttgatcgatcacct

SEQ ID NO: 19884 - DNA, 60 bp, Artificial Sequence
  Description of Artificial Sequence: Synthetic probe
cagaggcagattcaaattaatttagctgattggacagagagtgaggacggaaaagagggt

SEQ ID NO: 19885 - DNA, 60 bp, Artificial Sequence
  Description of Artificial Sequence: Synthetic probe
gggtgatgatgagtgggagtcgaccagatttgcagaagataggttgggtgaagaaatagc

SEQ ID NO: 19886 - DNA, 60 bp, Artificial Sequence
  Description of Artificial Sequence: Synthetic probe
ccgaagaggtgcactacgtcggatgcggtgatctacgtaccttgatgcagtttaagaaac

SEQ ID NO: 19887 - DNA, 60 bp, Artificial Sequence
  Description of Artificial Sequence: Synthetic probe
ggcagacgtagaatccgtatgcgtaagggatttggtgacgcactgaggaattacgccttc

SEQ ID NO: 19888 - DNA, 60 bp, Artificial Sequence
  Description of Artificial Sequence: Synthetic probe
gcctgagccacacgcagtactctacgtcacaaacgagctctctcatatcgttaagagtgg

SEQ ID NO: 19889 - DNA, 60 bp, Artificial Sequence
  Description of Artificial Sequence: Synthetic probe
ttgggtcttagctttacagctaccggtcaatccacaggtagtgtgggatgtgccgcgcag

SEQ ID NO: 19890 - DNA, 58 bp, Artificial Sequence
  Description of Artificial Sequence: Synthetic probe
agacacaatttgggtcttagctttacagctaccggtcaatccacaggtagtgtgggat

SEQ ID NO: 19891 - DNA, 60 bp, Artificial Sequence
  Description of Artificial Sequence: Synthetic probe
actgattttaggaggcaagacacaatttgggtcttagctttacagctaccggtcaatcca

SEQ ID NO: 19892 - DNA, 51 bp, Artificial Sequence
  Description of Artificial Sequence: Synthetic probe
ctatcgcatatacaatagactgcaagggtatattgaggcagtgcaattaca

SEQ ID NO: 19893 - DNA, 60 bp, Artificial Sequence
  Description of Artificial Sequence: Synthetic probe
gcatcgtacgcagaagcgtttcgtgatgatgtgaggctaagacagattaagcgccatgtc

SEQ ID NO: 19894 - DNA, 60 bp, Artificial Sequence
  Description of Artificial Sequence: Synthetic probe
ggctgtgactgccgtggtgtgtggcccagatatgatccaagtgtcattgaatgctggtgc

SEQ ID NO: 19895 - DNA, 60 bp, Artificial Sequence
  Description of Artificial Sequence: Synthetic probe
aggctgtgactgccgtggtgtgtggcccagatatgatccaagtgtcattgaatgctggtg

SEQ ID NO: 19896 - DNA, 60 bp, Artificial Sequence
  Description of Artificial Sequence: Synthetic probe
cgcatcgtacgcagaagcgtttcgtgatgatgtgaggctaagacagatcaaacgtcacgt

SEQ ID NO: 19897 - DNA, 60 bp, Artificial Sequence
  Description of Artificial Sequence: Synthetic probe
ctgactttaggagacaggacacgatttgggttttagccttacagctaccggtaaatccgc

SEQ ID NO: 19898 - DNA, 58 bp, Artificial Sequence
  Description of Artificial Sequence: Synthetic probe
gaccgtgtcgttcagtacacgtatgaaattgcacgacttcaggcaaatatgggacagt

SEQ ID NO: 19899 - DNA, 58 bp, Artificial Sequence
  Description of Artificial Sequence: Synthetic probe
gaccgtgtcgttcagtacacatatgaaattgcacgacttcaggcaaatatgggacagt

SEQ ID NO: 19900 - DNA, 54 bp, Artificial Sequence
  Description of Artificial Sequence: Synthetic probe
gaccgtgtcgttcagtacacatatgaaattgcacgacttcaggcaaatatggga

SEQ ID NO: 19901 - DNA, 60 bp, Artificial Sequence
  Description of Artificial Sequence: Synthetic probe
attgtgaatccaacatttatatcaagatatcgccaaattgcatactatttctacaacccg

SEQ ID NO: 19902 - DNA, 66 bp, Artificial Sequence
  Description of Artificial Sequence: Synthetic probe
gtcaaattgtgaatccaacatttatatcaagatatcgccaaattgcatactatttctacaatccgg

SEQ ID NO: 19903 - DNA, 60 bp, Artificial Sequence
  Description of Artificial Sequence: Synthetic probe
ggtcaaattgtaaatccaacatttatatcaagatatcgccaaattgcatactatttctac

SEQ ID NO: 19904 - DNA, 60 bp, Artificial Sequence
  Description of Artificial Sequence: Synthetic probe
aaagaaggtcaaattgtgaatccaacatttatatcaagatatcgccaaattgcatactat

SEQ ID NO: 19905 - DNA, 60 bp, Artificial Sequence
  Description of Artificial Sequence: Synthetic probe
gcggaatgattttgatcgaaatgagatgcccgacttgccaggtgtgatgaggtcaaatta

SEQ ID NO: 19906 - DNA, 60 bp, Artificial Sequence
  Description of Artificial Sequence: Synthetic probe
accacaatggacttgcagtcatctaaaaaggaattgtctattcaatgggatgtgtgttaa

SEQ ID NO: 19907 - DNA, 60 bp, Artificial Sequence
  Description of Artificial Sequence: Synthetic probe
gctatttcaccacaatggacttgcagtcatctaaaaaggaattgtttatttaatgggatg

SEQ ID NO: 19908 - DNA, 60 bp, Artificial Sequence
  Description of Artificial Sequence: Synthetic probe
ccaagtcattgctatatgacatctatctctcatcagtgtgcggtggtgtgtcggatggcg

SEQ ID NO: 19909 - DNA, 60 bp, Artificial Sequence
  Description of Artificial Sequence: Synthetic probe
gctggcgctagaggtgatgtgcaacagatttttcagggccgtaatgatcccatgatgata

SEQ ID NO: 19910 - DNA, 60 bp, Artificial Sequence
  Description of Artificial Sequence: Synthetic probe
aatgctggtgctagaggtgatgtgcaacagatttttcagggccgtaatgatcccatgatg

SEQ ID NO: 19911 - DNA, 60 bp, Artificial Sequence
  Description of Artificial Sequence: Synthetic probe
ctgtcgcaacgggacgagcaatagagggggcgtataaattaaagaaggtcatcaatgcac

SEQ ID NO: 19912 - DNA, 60 bp, Artificial Sequence
  Description of Artificial Sequence: Synthetic probe
aatgtgttgggtacaggcgaagaattgcctgatcccctcagccctggtgagcgcggcatg

SEQ ID NO: 19913 - DNA, 60 bp, Artificial Sequence
  Description of Artificial Sequence: Synthetic probe
gaatgtgttgggtacaggcgaagaattgcctgatcccctcagccctggtgagcgcggcat

SEQ ID NO: 19914 - DNA, 60 bp, Artificial Sequence
  Description of Artificial Sequence: Synthetic probe
gaaaaagatttactcaacgattggaaaagcagcggaacgttttgcagaaagtgaaatagg

SEQ ID NO: 19915 - DNA, 60 bp, Artificial Sequence
  Description of Artificial Sequence: Synthetic probe
cgggaatgctttgacttcgaatacagcgaaaaagatttactcaacgattggaaaagcagc

SEQ ID NO: 19916 - DNA, 60 bp, Artificial Sequence
  Description of Artificial Sequence: Synthetic probe
cttagtcgttttggaaaaaaggtcgggaatgctttgacatcgaatacagcgaaaaagatt

SEQ ID NO: 19917 - DNA, 60 bp, Artificial Sequence
  Description of Artificial Sequence: Synthetic probe
gcggtgaggatgagtttcactgagttctcgtcagtcccgctagatggtttcgaactacca

SEQ ID NO: 19918 - DNA, 60 bp, Artificial Sequence
  Description of Artificial Sequence: Synthetic probe
aatgctggtgctagaggtgatgtgcaacaaatttttcagggtcgtaatgatcctatgatg

SEQ ID NO: 19919 - DNA, 60 bp, Artificial Sequence
  Description of Artificial Sequence: Synthetic probe
ctgtgatgcgagcatgtgctacgcttcaagaagcaagaattgtattggaagctaatgtga

SEQ ID NO: 19920 - DNA, 60 bp, Artificial Sequence
  Description of Artificial Sequence: Synthetic probe
atacaatttctcagccgccaagatatgctccgggcgcgccaatgccatcatctatgccca

SEQ ID NO: 19921 - DNA, 60 bp, Artificial Sequence
  Description of Artificial Sequence: Synthetic probe
gaatcaagatcgtttttatgtgttgctaatgattgcggcgtcggacacaaataatggcag

SEQ ID NO: 19922 - DNA, 60 bp, Artificial Sequence
  Description of Artificial Sequence: Synthetic probe
gcgacgcctgagataccgttcacgactgaggccgcgaatgagattgcgcgtgttaccgga

SEQ ID NO: 19923 - DNA, 57 bp, Artificial Sequence
  Description of Artificial Sequence: Synthetic probe
tatcgtacacatgacgttgttggtcgccgctgtcgtagcgttgttgacgtctgtatg

SEQ ID NO: 19924 - DNA, 60 bp, Artificial Sequence
  Description of Artificial Sequence: Synthetic probe
cagctctgacagcggagattttcaatgtatatagttttagagatcacacatggcatggac

SEQ ID NO: 19925 - DNA, 60 bp, Artificial Sequence
  Description of Artificial Sequence: Synthetic probe
cagctctgacagcggagattttcaatgtatatagttttagagaccacacatggcatggac

SEQ ID NO: 19926 - DNA, 60 bp, Artificial Sequence
  Description of Artificial Sequence: Synthetic probe
atcaatatccagctctgacagcggagattttcaatgtatatagttttagagaccacacat

SEQ ID NO: 19927 - DNA, 60 bp, Artificial Sequence
  Description of Artificial Sequence: Synthetic probe
cgctaaatcaatatccagctctgacagcggagattttcaatgtatatagttttagagatc

SEQ ID NO: 19928 - DNA, 60 bp, Artificial Sequence
  Description of Artificial Sequence: Synthetic probe
caatggataagacgctaaatcaatatccagctctgacagcggagattttcaatgtatata

SEQ ID NO: 19929 - DNA, 60 bp, Artificial Sequence
  Description of Artificial Sequence: Synthetic probe
gatccaagttgtgttttatatttcaatggataagacgctaaatcaatatccagctctgac

SEQ ID NO: 19930 - DNA, 60 bp, Artificial Sequence
  Description of Artificial Sequence: Synthetic probe
gggtggacaactgagggtgcattcgatggggattgcgaaacatcggatatgtgataagtc

SEQ ID NO: 19931 - DNA, 60 bp, Artificial Sequence
  Description of Artificial Sequence: Synthetic probe
caccccggcgattcaaagaagagacaggatgcggatgacacccataaagaattcggctcg

SEQ ID NO: 19932 - DNA, 60 bp, Artificial Sequence
  Description of Artificial Sequence: Synthetic probe
tttcaccccggcgattcaaagaagagacaggatgcggatgacacccataaagaattcggc

SEQ ID NO: 19933 - DNA, 60 bp, Artificial Sequence
  Description of Artificial Sequence: Synthetic probe
ctgaaccaaacctactcaccatcgattttgagaaagatgcttaccttggcgcgcgttctg

SEQ ID NO: 19934 - DNA, 60 bp, Artificial Sequence
  Description of Artificial Sequence: Synthetic probe
caagaacacgtaaatatatttaaggtaggcggttccgcaacagatgatgggagattttac

SEQ ID NO: 19935 - DNA, 60 bp, Artificial Sequence
  Description of Artificial Sequence: Synthetic probe
gaacgaaatcgctgaacttaataggataagggatgagtggaaaaacgccgcatatgatag

SEQ ID NO: 19936 - DNA, 60 bp, Artificial Sequence
  Description of Artificial Sequence: Synthetic probe
aagcacgagcgagagttaccaggttggaacgcagagatggatacagctgcgtagaggtac

SEQ ID NO: 19937 - DNA, 60 bp, Artificial Sequence
  Description of Artificial Sequence: Synthetic probe
caagatacccgaatcggatatgatcgacgtaccaaggtcaagtatcatagaggctctaaa

SEQ ID NO: 19938 - DNA, 60 bp, Artificial Sequence
  Description of Artificial Sequence: Synthetic probe
gttaaaagagtgttctaccatggaggagttcgtcataccggtgttttctgagagagatat

SEQ ID NO: 19939 - DNA, 60 bp, Artificial Sequence
  Description of Artificial Sequence: Synthetic probe
ctaggtgcgactttcataatgatggtttgtgcgaagagtgagagagggctaaaccagcag

SEQ ID NO: 19940 - DNA, 60 bp, Artificial Sequence
  Description of Artificial Sequence: Synthetic probe
ctaggagcgactttcataatgatggtttgtgcgaagagtgagagagggctaaaccagcag

SEQ ID NO: 19941 - DNA, 60 bp, Artificial Sequence
  Description of Artificial Sequence: Synthetic probe
cgcagtgaggatgagttttacagagttctcgtcgatcccgctggatggttttgaaatgcc

SEQ ID NO: 19942 - DNA, 60 bp, Artificial Sequence
  Description of Artificial Sequence: Synthetic probe
gttccaagaggcgtatcgagagtttttaggtcgtgcgatgatggatccctcgagcggagc

SEQ ID NO: 19943 - DNA, 60 bp, Artificial Sequence
  Description of Artificial Sequence: Synthetic probe
gagataggccaattccagatgattcactagcagtcagcgtacttgagaagaggagggcga

SEQ ID NO: 19944 - DNA, 50 bp, Artificial Sequence
  Description of Artificial Sequence: Synthetic probe
ctaagcggcatcgacttgactcatttacgcacgcctaagatagagcccag

SEQ ID NO: 19945 - DNA, 60 bp, Artificial Sequence
  Description of Artificial Sequence: Synthetic probe
gtactgcttaatgtgctaggcagtggtgaagaattacctgaccccctaagtccaggagaa

SEQ ID NO: 19946 - DNA, 60 bp, Artificial Sequence
  Description of Artificial Sequence: Synthetic probe
agtgttgggagtcgaatttaagaatgtgttacctgtgttgaccgccgagcatcgtgcgat

SEQ ID NO: 19947 - DNA, 60 bp, Artificial Sequence
  Description of Artificial Sequence: Synthetic probe
cgtgcgagcgtgttgcttttgtctctaaggacatgagcttaatcatattgccggtcggtg

SEQ ID NO: 19948 - DNA, 60 bp, Artificial Sequence
  Description of Artificial Sequence: Synthetic probe
cgtgtgagcgtgttgcttttgtctctaaggacatgagcttgatcatattgccggtcggtg

SEQ ID NO: 19949 - DNA, 60 bp, Artificial Sequence
  Description of Artificial Sequence: Synthetic probe
gcgtgtgagcgtgttgcttttgtctctaaggacatgagcttaatcatattgccggtcggc

SEQ ID NO: 19950 - DNA, 60 bp, Artificial Sequence
  Description of Artificial Sequence: Synthetic probe
tgctaccgagacgactattttctacttgatttataatgtcgagttctccaacacgccgga

SEQ ID NO: 19951 - DNA, 60 bp, Artificial Sequence
  Description of Artificial Sequence: Synthetic probe
acttactgattttagaaggcaggataccatatgggtgctagctctgcagttgcccgtgaa

SEQ ID NO: 19952 - DNA, 60 bp, Artificial Sequence
  Description of Artificial Sequence: Synthetic probe
gcgactacactggaacatagatttgaagacataccagataaaaaactcgctatgagcatt

SEQ ID NO: 19953 - DNA, 51 bp, Artificial Sequence
  Description of Artificial Sequence: Synthetic probe
cgatggttgcaaccacgttggaacatagatttgaagacataccagataaaa

SEQ ID NO: 19954 - DNA, 60 bp, Artificial Sequence
  Description of Artificial Sequence: Synthetic probe
cgattgacggaatagttcaaggtagcgttcactcaatcatgactggggagtcatacggcg

SEQ ID NO: 19955 - DNA, 60 bp, Artificial Sequence
  Description of Artificial Sequence: Synthetic probe
tgcggcgattgacggaatagttcaaggtagcgttcactcaatcatgactggggagtcata

SEQ ID NO: 19956 - DNA, 60 bp, Artificial Sequence
  Description of Artificial Sequence: Synthetic probe
cttccttatgcgcggggctagctgactctctagtgtatacgctgcctgtagcgcacccga

SEQ ID NO: 19957 - DNA, 60 bp, Artificial Sequence
  Description of Artificial Sequence: Synthetic probe
cgggcggttcatgggtatataaagacgtcagcggaatctttagagtatgcgttagggcca

SEQ ID NO: 19958 - DNA, 60 bp, Artificial Sequence
  Description of Artificial Sequence: Synthetic probe
gctcattccgaaagagaaaacatgagcgagagttatcaggttgggacgcagagatggata

SEQ ID NO: 19959 - DNA, 60 bp, Artificial Sequence
  Description of Artificial Sequence: Synthetic probe
gcggggtgcaactgcttgaggattaccgcaaaagtgggatgatggatgaggccgtgaagc

SEQ ID NO: 19960 - DNA, 60 bp, Artificial Sequence
  Description of Artificial Sequence: Synthetic probe
tgcggggtgcaactgcttgaggattaccgcaaaagtgggatgatggatgaggccgtgaag

SEQ ID NO: 19961 - DNA, 60 bp, Artificial Sequence
  Description of Artificial Sequence: Synthetic probe
ttattcagttttgagacctgagttcgcaatccacggcgtgaatccaatgcctggcccgct

SEQ ID NO: 19962 - DNA, 60 bp, Artificial Sequence
  Description of Artificial Sequence: Synthetic probe
cgcatgctggttgccgcaggtaaagattcggaggcagcgtattttcgcagtatgttacct

SEQ ID NO: 19963 - DNA, 60 bp, Artificial Sequence
  Description of Artificial Sequence: Synthetic probe
cagtgaggatgaagatgagagggcttatgctacgatgtttgagatggttcgatgcattat

SEQ ID NO: 19964 - DNA, 60 bp, Artificial Sequence
  Description of Artificial Sequence: Synthetic probe
ggggccggaactcagtgaggatgaagatgagagggcttatgctacgatgtttgaaatggt

SEQ ID NO: 19965 - DNA, 60 bp, Artificial Sequence
  Description of Artificial Sequence: Synthetic probe
tgagggggccggaactcagtgaggatgaagatgagagggcttatgctacgatgtttgaaa

SEQ ID NO: 19966 - DNA, 60 bp, Artificial Sequence
  Description of Artificial Sequence: Synthetic probe
ttagttcgcgatgaacaaattggcaggatcggagatcattattatacaacaaattgttac

SEQ ID NO: 19967 - DNA, 60 bp, Artificial Sequence
  Description of Artificial Sequence: Synthetic probe
atgtctagttgcgcttgcacggggcgcgctggccatacctgagtgtcagttgtggggagt

SEQ ID NO: 19968 - DNA, 60 bp, Artificial Sequence
  Description of Artificial Sequence: Synthetic probe
ttggaggcgtattgaaattttcgcgaatgcccagggtaattcggttcaaactcaagcggg

SEQ ID NO: 19969 - DNA, 59 bp, Artificial Sequence
  Description of Artificial Sequence: Synthetic probe
atatgcggaccggatatgatccaggtatcgctgaatgccggcgcaagagcagatataca

SEQ ID NO: 19970 - DNA, 60 bp, Artificial Sequence
  Description of Artificial Sequence: Synthetic probe
tggggtccagctcgtcaggcgtacggtttcttcctagagagtgaggaggtgtttcagccg

SEQ ID NO: 19971 - DNA, 60 bp, Artificial Sequence
  Description of Artificial Sequence: Synthetic probe
caattaatagatacaatgggttaacactgaggggagtaacaatgaggccgacatcgcaag

SEQ ID NO: 19972 - DNA, 60 bp, Artificial Sequence
  Description of Artificial Sequence: Synthetic probe
ttgacggctcattggcacgcactgggggcggctcagatggctgtaggacgcacgctaacc

SEQ ID NO: 19973 - DNA, 60 bp, Artificial Sequence
  Description of Artificial Sequence: Synthetic probe
cacaaaaagcggagaaggctgcattcgcatcgtacgcggaagcgtttcgtgatgatgtaa

SEQ ID NO: 19974 - DNA, 60 bp, Artificial Sequence
  Description of Artificial Sequence: Synthetic probe
cacaaaaagcggagaaggctgcattcgcatcgtacgcggaagcgtttcgtgatgatgtga

SEQ ID NO: 19975 - DNA, 58 bp, Artificial Sequence
  Description of Artificial Sequence: Synthetic probe
tcgatcacctctaaagggtccagggtaccttcttgacgtagggcgatttcttttttac

SEQ ID NO: 19976 - DNA, 60 bp, Artificial Sequence
  Description of Artificial Sequence: Synthetic probe
agtgggatctggatcaagcacaaaaggacctggagaacgcgcgaacgagaatgctgacag

SEQ ID NO: 19977 - DNA, 60 bp, Artificial Sequence
  Description of Artificial Sequence: Synthetic probe
cctccggatgatgttttgcagggcttaccttttagctatgacactaacgagagaggtggg

SEQ ID NO: 19978 - DNA, 60 bp, Artificial Sequence
  Description of Artificial Sequence: Synthetic probe
aggcggcgtattttcgtagtatgttacccttccatatggtaagattcgctagaatcaacc

SEQ ID NO: 19979 - DNA, 60 bp, Artificial Sequence
  Description of Artificial Sequence: Synthetic probe
caagtagtttgggacgttcctcggagctcaattgctaacctcatcatgaacatagcgacg

SEQ ID NO: 19980 - DNA, 60 bp, Artificial Sequence
  Description of Artificial Sequence: Synthetic probe
ggaaacgttgcgactcgcgaggttgatgtgtttatcggtgcatgttccgaaccagtttac

SEQ ID NO: 19981 - DNA, 60 bp, Artificial Sequence
  Description of Artificial Sequence: Synthetic probe
gcaaatcggcaggattggagatcattattatacaacaaattgttacactggagcggaggc

SEQ ID NO: 19982 - DNA, 60 bp, Artificial Sequence
  Description of Artificial Sequence: Synthetic probe
gatgagcaaatcggcaggattggagatcattattatacaacaaattgttacactggagcg

SEQ ID NO: 19983 - DNA, 60 bp, Artificial Sequence
  Description of Artificial Sequence: Synthetic probe
aaatgccattaacctgaggacagcaggtagagtggcgccccgaggtttacgtcgtgcagg

SEQ ID NO: 19984 - DNA, 60 bp, Artificial Sequence
  Description of Artificial Sequence: Synthetic probe
gcgagcatgtgctacgcttcaggaagcaagaatcgtattggaagctaatgtgatggagat

SEQ ID NO: 19985 - DNA, 64 bp, Artificial Sequence
  Description of Artificial Sequence: Synthetic probe
gaggataaagtaatacatcctaaagtaatgatgaaatttaaaattcccagatcacagcaaccgc

SEQ ID NO: 19986 - DNA, 60 bp, Artificial Sequence
  Description of Artificial Sequence: Synthetic probe
tggaattgaggataaagtaatacatcctaaagtaatgatgaaatttaaaaatccaagatc

SEQ ID NO: 19987 - DNA, 60 bp, Artificial Sequence
  Description of Artificial Sequence: Synthetic probe
tggaattgaggataaagtaatacatcctaaagtaatgatgaaatttaaaattcccagatc

SEQ ID NO: 19988 - DNA, 60 bp, Artificial Sequence
  Description of Artificial Sequence: Synthetic probe
ctaaaacagaagtgcctccatggtttaaaggccttaacccaatgcttggcgttgttaatt

SEQ ID NO: 19989 - DNA, 60 bp, Artificial Sequence
  Description of Artificial Sequence: Synthetic probe
attgctcgcgccgcttacgcatagtccactttgcacgggtgtgggttatgcgggtggtgt

SEQ ID NO: 19990 - DNA, 60 bp, Artificial Sequence
  Description of Artificial Sequence: Synthetic probe
acgtgcaattgcacgcgccgcttgcgcatagtccactttgcacgggtgtgggttatgtgg

SEQ ID NO: 19991 - DNA, 60 bp, Artificial Sequence
  Description of Artificial Sequence: Synthetic probe
acacgtgcgattgctcgcgccgcttacgcatagtccactttgcacgggtgtgggttatgc

SEQ ID NO: 19992 - DNA, 60 bp, Artificial Sequence
  Description of Artificial Sequence: Synthetic probe
tacacgtgcgattgctcgcgccgcttacgcatagtccactttgcacgggtgtgggttatg

SEQ ID NO: 19993 - DNA, 60 bp, Artificial Sequence
  Description of Artificial Sequence: Synthetic probe
aggacgcaagcagaggaagaaagcccatggcgacgcgcagagagaaggtgtcgaggaaga

SEQ ID NO: 19994 - DNA, 60 bp, Artificial Sequence
  Description of Artificial Sequence: Synthetic probe
aggacgcaagcagaggaagaaagcccatggcgacgcgcacagagaaggtgtcgaggaaga

SEQ ID NO: 19995 - DNA, 60 bp, Artificial Sequence
  Description of Artificial Sequence: Synthetic probe
cggggaagttatcaatctcgctgcgcgtatgtctcagatgtggatggagtattagttact

SEQ ID NO: 19996 - DNA, 60 bp, Artificial Sequence
  Description of Artificial Sequence: Synthetic probe
ggtttcgaattaccattaacctaagatcagtaggtggagtggcgccccgaggtcgtatcg

SEQ ID NO: 19997 - DNA, 60 bp, Artificial Sequence
  Description of Artificial Sequence: Synthetic probe
aggtttgcgtcgtgcagggtggttgacctcgcggcgtagactcccactgctgtataacgg

SEQ ID NO: 19998 - DNA, 60 bp, Artificial Sequence
  Description of Artificial Sequence: Synthetic probe
gtggcgccccgaggtttgcgtcgtgcagggtggttgacctcgcggcgtagactcccactg

SEQ ID NO: 19999 - DNA, 60 bp, Artificial Sequence
  Description of Artificial Sequence: Synthetic probe
acctaagatcagtaggtagagtggcgccccgaggtttgcaccgcgtggagtggtgatcca

SEQ ID NO: 20000 - DNA, 60 bp, Artificial Sequence
  Description of Artificial Sequence: Synthetic probe
atacttggagatcgattggacgtacccctcttcttacgaaatgcatgaacgcagcgacgg

SEQ ID NO: 20001 - DNA, 60 bp, Artificial Sequence
  Description of Artificial Sequence: Synthetic probe
aagtttggatgcaaaatacttggagatcgattggacgtacccctcttcttacgaaatgca

SEQ ID NO: 20002 - DNA, 60 bp, Artificial Sequence
  Description of Artificial Sequence: Synthetic probe
ctcattggcacgcattaggggcggctcaaatggctgtgggacgtacactagtcgaagcgt

SEQ ID NO: 20003 - DNA, 60 bp, Artificial Sequence
  Description of Artificial Sequence: Synthetic probe
ccattacgaagatttgacggctcattggcacgcattaggggcggctcaaatggctgtagg

SEQ ID NO: 20004 - DNA, 60 bp, Artificial Sequence
  Description of Artificial Sequence: Synthetic probe
aagtatcgatttagtccattacgaagatttgacggctcattggcacgcattaggggcggc

SEQ ID NO: 20005 - DNA, 60 bp, Artificial Sequence
  Description of Artificial Sequence: Synthetic probe
gttgaagaaagtaattaatgccttaagcgggatagatctaacacatttacgtacgccgaa

SEQ ID NO: 20006 - DNA, 60 bp, Artificial Sequence
  Description of Artificial Sequence: Synthetic probe
ggggcatataagttgaagaaagtaattaatgccttaagcgggatagatctaacacattta

SEQ ID NO: 20007 - DNA, 55 bp, Artificial Sequence
  Description of Artificial Sequence: Synthetic probe
ggggcatataagttgaagaaagtaattaatgccttaagcgggatagatctaacac

SEQ ID NO: 20008 - DNA, 60 bp, Artificial Sequence
  Description of Artificial Sequence: Synthetic probe
cgactgggagagcaatcgagggggcatataagttgaagaaagtaattaatgccttaagcg

SEQ ID NO: 20009 - DNA, 60 bp, Artificial Sequence
  Description of Artificial Sequence: Synthetic probe
taattggagcaggtatggcgacggctgtcgcgactgggagagcaatcgagggggcatata

SEQ ID NO: 20010 - DNA, 60 bp, Artificial Sequence
  Description of Artificial Sequence: Synthetic probe
agcgggaatgaccgctgatgtattagaggcggcgtctgaagaggtgcctttaattggagc

SEQ ID NO: 20011 - DNA, 60 bp, Artificial Sequence
  Description of Artificial Sequence: Synthetic probe
gatacaggagatagcgggaatgaccgctgatgtattagaggcggcgtctgaagaagtgcc

SEQ ID NO: 20012 - DNA, 60 bp, Artificial Sequence
  Description of Artificial Sequence: Synthetic probe
gaagaagcgatacaggagatagcgggaatgaccgctgatgtattagaggcggcgtctgaa

SEQ ID NO: 20013 - DNA, 60 bp, Artificial Sequence
  Description of Artificial Sequence: Synthetic probe
gtgagagaacacacgcggaaacatccatggtgaaggaatatcgggataagattgacgctc

SEQ ID NO: 20014 - DNA, 60 bp, Artificial Sequence
  Description of Artificial Sequence: Synthetic probe
tggtgagagaacacacgcggaaacatccatggtgaaggaatatcgggataagattgacgc

SEQ ID NO: 20015 - DNA, 60 bp, Artificial Sequence
  Description of Artificial Sequence: Synthetic probe
cccttagcgaagatgggtaaaatcatacgatctctgagcagatttgggaagaaagtgggt

SEQ ID NO: 20016 - DNA, 60 bp, Artificial Sequence
  Description of Artificial Sequence: Synthetic probe
cccttagcgaagatgggtaaaatcatacgatctctgagcagatttgggaagaaagtaggt

SEQ ID NO: 20017 - DNA, 60 bp, Artificial Sequence
  Description of Artificial Sequence: Synthetic probe
tatacccaacatatggctacaattggtgtactagcaacgccagagataccctttacaacg

SEQ ID NO: 20018 - DNA, 60 bp, Artificial Sequence
  Description of Artificial Sequence: Synthetic probe
ggcaggaaggcttctactacacgaatatgttagaagccccaccggagatagatcgtgtgg

SEQ ID NO: 20019 - DNA, 50 bp, Artificial Sequence
  Description of Artificial Sequence: Synthetic probe
gctcgagattgctccgctgattgagtctgtttatgcgtctgagctgtccg

SEQ ID NO: 20020 - DNA, 60 bp, Artificial Sequence
  Description of Artificial Sequence: Synthetic probe
cgctgattggtgcggggatggctacggctgtagcgacaggaagagctatagagggagcat

SEQ ID NO: 20021 - DNA, 60 bp, Artificial Sequence
  Description of Artificial Sequence: Synthetic probe
ggatccggcagtaagaatggtcgctggcgtcgtaggtcatttgctctttacagcgggcgg

SEQ ID NO: 20022 - DNA, 60 bp, Artificial Sequence
  Description of Artificial Sequence: Synthetic probe
cccaaagaataacaacaacggggccgttcgctattctgactggatcaaccccaactgcgc

SEQ ID NO: 20023 - DNA, 55 bp, Artificial Sequence
  Description of Artificial Sequence: Synthetic probe
gggttttagctttacagctaccggtcaatccacaagtagtgtgggatgtaccgcg

SEQ ID NO: 20024 - DNA, 60 bp, Artificial Sequence
  Description of Artificial Sequence: Synthetic probe
ggttgcaagggtacattgaggcagtgcaactacaagagttaaggaactcaattgggtggt

SEQ ID NO: 20025 - DNA, 60 bp, Artificial Sequence
  Description of Artificial Sequence: Synthetic probe
gaatttaagaatgtaccacctgtgttgacagccgagcatcgcgcaatgattcagagcgca

SEQ ID NO: 20026 - DNA, 60 bp, Artificial Sequence
  Description of Artificial Sequence: Synthetic probe
cccgaccagagatcatcgcggtatggaggctgctgaaccagaagtgttaggagttgaatt

SEQ ID NO: 20027 - DNA, 60 bp, Artificial Sequence
  Description of Artificial Sequence: Synthetic probe
ggtgcggttcatacgcggaaagggatcctttatattgcatgatatcccgaccagagatca

SEQ ID NO: 20028 - DNA, 60 bp, Artificial Sequence
  Description of Artificial Sequence: Synthetic probe
gccactgctttctgtgttcgcgttgcaagaaataatgcaaaaggtaagacaagtgcaagc

SEQ ID NO: 20029 - DNA, 60 bp, Artificial Sequence
  Description of Artificial Sequence: Synthetic probe
ggagaggagctggagcaggtatatgagtttatgagtggtgcggcaaaagaagaggcgggg

SEQ ID NO: 20030 - DNA, 60 bp, Artificial Sequence
  Description of Artificial Sequence: Synthetic probe
taaagaaaagtttggagaggagctggagcaggtatatgagtttatgagtggtgcggcaaa

SEQ ID NO: 20031 - DNA, 60 bp, Artificial Sequence
  Description of Artificial Sequence: Synthetic probe
cgacgaactacttacgaaactcttaaatatataatcccgtgactgggattgagcgcgttt

SEQ ID NO: 20032 - DNA, 60 bp, Artificial Sequence
  Description of Artificial Sequence: Synthetic probe
tcggtaacgacgaactacttacgaaactcttaaatatataatcccgtgactggggttgag

SEQ ID NO: 20033 - DNA, 60 bp, Artificial Sequence
  Description of Artificial Sequence: Synthetic probe
cgagtgaccatctaaaagggattgtacaaatttccgtacgacctgatcgtacatttagtg

SEQ ID NO: 20034 - DNA, 59 bp, Artificial Sequence
  Description of Artificial Sequence: Synthetic probe
ttcctttatcgagcaaccatttaaaagggattgtacaaatttccgtacgacctggtcgt

SEQ ID NO: 20035 - DNA, 60 bp, Artificial Sequence
  Description of Artificial Sequence: Synthetic probe
ttcctttatcgagcaaccatttaaaagggattgtacaaatttccgtacgacctggtcgta

SEQ ID NO: 20036 - DNA, 60 bp, Artificial Sequence
  Description of Artificial Sequence: Synthetic probe
gatcggttctatgtgctgatggtgatagccgcttcagatacaaacaatagcagggtttgg

SEQ ID NO: 20037 - DNA, 60 bp, Artificial Sequence
  Description of Artificial Sequence: Synthetic probe
aaagatcaggatcggttctatgtgctgatggtgatagccgcttcagacacaaacaatagt

SEQ ID NO: 20038 - DNA, 60 bp, Artificial Sequence
  Description of Artificial Sequence: Synthetic probe
agcgtaatgatcaggatcggttctatgtgctgatggtgatagccgcttcagatacaaaca

SEQ ID NO: 20039 - DNA, 60 bp, Artificial Sequence
  Description of Artificial Sequence: Synthetic probe
gttaaaaagtgttctcctactcgcagaagatggggaagataattaaatcgctaagtagat

SEQ ID NO: 20040 - DNA, 60 bp, Artificial Sequence
  Description of Artificial Sequence: Synthetic probe
gcgttgctcaggttgttctgcttcgtgtgttacggatatgcgccgcgtgtggatgggacg

SEQ ID NO: 20041 - DNA, 60 bp, Artificial Sequence
  Description of Artificial Sequence: Synthetic probe
gttcatgagtctatcaagcgctatgcctcaagcgagtggcggatttgatcgtatgattgt

SEQ ID NO: 20042 - DNA, 60 bp, Artificial Sequence
  Description of Artificial Sequence: Synthetic probe
ccgcagtggtttaagaatctaaatcctatgcttggagtagtaaatctaggagcgactttc

SEQ ID NO: 20043 - DNA, 60 bp, Artificial Sequence
  Description of Artificial Sequence: Synthetic probe
aacggaaataccgcagtggtttaagaatctaaatcctatgcttggagtagtaaatctagg

SEQ ID NO: 20044 - DNA, 60 bp, Artificial Sequence
  Description of Artificial Sequence: Synthetic probe
taaacccgacatatacgatgactaaagtcttcattaataagagaatcgttgagcgagtac

SEQ ID NO: 20045 - DNA, 60 bp, Artificial Sequence
  Description of Artificial Sequence: Synthetic probe
gataaacccgacatatacgatgactaaagtcttcattaataagagaatcgttgagcgagt

SEQ ID NO: 20046 - DNA, 60 bp, Artificial Sequence
  Description of Artificial Sequence: Synthetic probe
ggatgactgctgatgtcttagaggcggcatctgaagaggtgcctctgatcggagcgggca

SEQ ID NO: 20047 - DNA, 60 bp, Artificial Sequence
  Description of Artificial Sequence: Synthetic probe
ggaatgactgctgatgtcttagaggcggcatctgaagaggtgcctctgatcggagcgggc

SEQ ID NO: 20048 - DNA, 51 bp, Artificial Sequence
  Description of Artificial Sequence: Synthetic probe
atatgagtgtggccttcaaaataaatgggaccaaaacagaagtgccttcat

SEQ ID NO: 20049 - DNA, 60 bp, Artificial Sequence
  Description of Artificial Sequence: Synthetic probe
aggctgcattcgcatcatacgcagaagcgtttcgtgatgatgtaagactgagacaaatta

SEQ ID NO: 20050 - DNA, 60 bp, Artificial Sequence
  Description of Artificial Sequence: Synthetic probe
gccaatggacgaagagaaggaaatatgtggaatagaggataaggttatacatccgaaagt

SEQ ID NO: 20051 - DNA, 60 bp, Artificial Sequence
  Description of Artificial Sequence: Synthetic probe
ggcgatggacgaagagaaggaaatatgtggaatagaggataaggttatacacccgaaagt

SEQ ID NO: 20052 - DNA, 60 bp, Artificial Sequence
  Description of Artificial Sequence: Synthetic probe
gggaaacagtttggcttcaatgctttaaaagcttttctcaaccatacgaagaggatgtcg

SEQ ID NO: 20053 - DNA, 60 bp, Artificial Sequence
  Description of Artificial Sequence: Synthetic probe
ggcaatgtatgatcgggaaacagtttggcttcaatgctttaaaagcttttctcaaccata

SEQ ID NO: 20054 - DNA, 60 bp, Artificial Sequence
  Description of Artificial Sequence: Synthetic probe
ggcgatgtatgatcgggaaacagtttggcttcaatgctttaaaagcttttctcaaccata

SEQ ID NO: 20055 - DNA, 51 bp, Artificial Sequence
  Description of Artificial Sequence: Synthetic probe
gcgatgatcgcggcaactgatgcggaggaaccggcgaaggcatatagatta

SEQ ID NO: 20056 - DNA, 60 bp, Artificial Sequence
  Description of Artificial Sequence: Synthetic probe
gtgaatcttatggagagtcagttaaacaggcggttcttctcaacgtgctaggtacaggcg

SEQ ID NO: 20057 - DNA, 60 bp, Artificial Sequence
  Description of Artificial Sequence: Synthetic probe
tctataattacaggtgaatcttatggagagtcagttaaacaggcggttcttctcaacgtg

SEQ ID NO: 20058 - DNA, 60 bp, Artificial Sequence
  Description of Artificial Sequence: Synthetic probe
cgctgctgtcgttgcactgttaacatcggtatgtacgctgtcaagtgacatgagtgtggc

SEQ ID NO: 20059 - DNA, 60 bp, Artificial Sequence
  Description of Artificial Sequence: Synthetic probe
ttcaaacagtattaaagatgtggtgcgagctacggcgtatttcacggcgccaaccggaga

SEQ ID NO: 20060 - DNA, 60 bp, Artificial Sequence
  Description of Artificial Sequence: Synthetic probe
tgttagtttcaaacagtattaaagatgtggtgcgagctacggcgtatttcacggcgccaa

SEQ ID NO: 20061 - DNA, 60 bp, Artificial Sequence
  Description of Artificial Sequence: Synthetic probe
tgaacgggaatcagcgccacgacttcaagttcaaagcgtggcgccaagggaagaatcacg

SEQ ID NO: 20062 - DNA, 60 bp, Artificial Sequence
  Description of Artificial Sequence: Synthetic probe
atcctaaaaagtgcatagtgttgataattgtgggggacgataaactggaaccgcatgtac

SEQ ID NO: 20063 - DNA, 60 bp, Artificial Sequence
  Description of Artificial Sequence: Synthetic probe
tccaccctggtgatgcgaaaaaacgacagaaggcggatgacacacacaaagagtttggat

SEQ ID NO: 20064 - DNA, 60 bp, Artificial Sequence
  Description of Artificial Sequence: Synthetic probe
gtccccattcgggtggtgcgttgtatacttttcggaaggtggctctgatgttgatggcga

SEQ ID NO: 20065 - DNA, 60 bp, Artificial Sequence
  Description of Artificial Sequence: Synthetic probe
tcatggagagatcgggaccaggaagtcggcggatccgtggaataagcgcgtcgtattcgg

SEQ ID NO: 20066 - DNA, 60 bp, Artificial Sequence
  Description of Artificial Sequence: Synthetic probe
acgccgttaatcaccagctttttaactgtattgttaaggctaggcccgcgaacgcagata

SEQ ID NO: 20067 - DNA, 60 bp, Artificial Sequence
  Description of Artificial Sequence: Synthetic probe
gtcccaagggtgagcattgtggaggctctcgctgctaagcctacgaggaatgatgggatc

SEQ ID NO: 20068 - DNA, 60 bp, Artificial Sequence
  Description of Artificial Sequence: Synthetic probe
gtcgaagggaagatgaagcggtgcggggtgcagctgctcgaagattaccgcaaaagtggg

SEQ ID NO: 20069 - DNA, 60 bp, Artificial Sequence
  Description of Artificial Sequence: Synthetic probe
cgaagaggatgtcgaagggaagatgaagcggtgcggggtgcagctgctcgaagattaccg

SEQ ID NO: 20070 - DNA, 60 bp, Artificial Sequence
  Description of Artificial Sequence: Synthetic probe
gcggatcccaacctgtggtgtgattgatgtacgcgcatcagagttaacggggtgctcgcc

SEQ ID NO: 20071 - DNA, 60 bp, Artificial Sequence
  Description of Artificial Sequence: Synthetic probe
acatcagctgagatacctcaatggtttaagagtttgaatccaatgttgggtgtggtcaat

SEQ ID NO: 20072 - DNA, 60 bp, Artificial Sequence
  Description of Artificial Sequence: Synthetic probe
cggtgcggattaattgcgtacctggaatatatggttttctttccctcaaaggcgattcga

SEQ ID NO: 20073 - DNA, 60 bp, Artificial Sequence
  Description of Artificial Sequence: Synthetic probe
gacgcgcagagagaaggtgtcgaggaagaaaagacgtctgaggagccggcacgcattgga

SEQ ID NO: 20074 - DNA, 60 bp, Artificial Sequence
  Description of Artificial Sequence: Synthetic probe
ggtggaacgcagtctccagaaagagttggggatttcccgtgagggggtggccgagcagac

SEQ ID NO: 20075 - DNA, 52 bp, Artificial Sequence
  Description of Artificial Sequence: Synthetic probe
cttctcaatgtatgacccgcttgaccgtgggtccgcgcgctatcatacttac

SEQ ID NO: 20076 - DNA, 59 bp, Artificial Sequence
  Description of Artificial Sequence: Synthetic probe
tgctaaaatatatgtgcgacattgttttacttaagttttcgggacatgtcttcggtaac

SEQ ID NO: 20077 - DNA, 60 bp, Artificial Sequence
  Description of Artificial Sequence: Synthetic probe
ctcgttgcgattgaagtatcagacgagagagtcccagcgagtataagggccagccatatc

SEQ ID NO: 20078 - DNA, 60 bp, Artificial Sequence
  Description of Artificial Sequence: Synthetic probe
ttatctgatggaattgtatggtatttacctatcacacacccaaataaatgcctcgttgcg

SEQ ID NO: 20079 - DNA, 60 bp, Artificial Sequence
  Description of Artificial Sequence: Synthetic probe
ccgtcgaaggcgttcagaactagcaagctagatgaggtgcagcctaagattgcgcgtgag

SEQ ID NO: 20080 - DNA, 60 bp, Artificial Sequence
  Description of Artificial Sequence: Synthetic probe
cacacacaaacaatggtctgtaccgttattcctatacgcgcacgaacttaaggttattcc

SEQ ID NO: 20081 - DNA, 60 bp, Artificial Sequence
  Description of Artificial Sequence: Synthetic probe
cgcgtcaaggaggccactatcatacaggaaatcatgtatcttaattttctacctctgttc

SEQ ID NO: 20082 - DNA, 60 bp, Artificial Sequence
  Description of Artificial Sequence: Synthetic probe
cgaatcacgatacatggtgacacgtataagggacgcacagggtcagaaccgaataaacgt

SEQ ID NO: 20083 - DNA, 60 bp, Artificial Sequence
  Description of Artificial Sequence: Synthetic probe
cccagatagttatatttgtgtttgactttctatttgagaggaggcgaacggtcagaggag

SEQ ID NO: 20084 - DNA, 56 bp, Artificial Sequence
  Description of Artificial Sequence: Synthetic probe
ctaagaaaccctgtccgactgttacagcgcaatataccctagaacgttacgcattg

SEQ ID NO: 20085 - DNA, 60 bp, Artificial Sequence
  Description of Artificial Sequence: Synthetic probe
ggggcaggcgctttcacgacaacagggacaatccacatatgatgaagagatttcaaagat

SEQ ID NO: 20086 - DNA, 60 bp, Artificial Sequence
  Description of Artificial Sequence: Synthetic probe
gcagaggttaacattagcgcgtttctatgacatccgtcctgctataatggggcaggcgct

SEQ ID NO: 20087 - DNA, 60 bp, Artificial Sequence
  Description of Artificial Sequence: Synthetic probe
atgacccaatggtgaaacgtacattatctcccatcgcctttgctcctattgtgttgcaga

SEQ ID NO: 20088 - DNA, 60 bp, Artificial Sequence
  Description of Artificial Sequence: Synthetic probe
gttctaacgatagatttcgaaaaggatgccaagctgacatctaatgaaggagtcgcgatg

SEQ ID NO: 20089 - DNA, 60 bp, Artificial Sequence
  Description of Artificial Sequence: Synthetic probe
gcggctgggaccaggaaaggttcaaaatgcataagatcctcaagtcacaaggaaatgttc

SEQ ID NO: 20090 - DNA, 55 bp, Artificial Sequence
  Description of Artificial Sequence: Synthetic probe
cctatttgattatgtcgccgaacctggaacaaagataatacactgggagtataag

SEQ ID NO: 20091 - DNA, 60 bp, Artificial Sequence
  Description of Artificial Sequence: Synthetic probe
atgcgattatggtatgattggagtgttaggcccacatatattccttatgaaaagtcaagg

SEQ ID NO: 20092 - DNA, 60 bp, Artificial Sequence
  Description of Artificial Sequence: Synthetic probe
ccgtgtttaagagggacgttgatcgcctctgagacgaagctaggtgatgtttattcgatg

SEQ ID NO: 20093 - DNA, 60 bp, Artificial Sequence
  Description of Artificial Sequence: Synthetic probe
gatgattgccgcttcggatacattcaatacgcgcgtgtggtggtcgaatccatatccgtg

SEQ ID NO: 20094 - DNA, 60 bp, Artificial Sequence
  Description of Artificial Sequence: Synthetic probe
ctatcaatccggtttcaggaggctatcgacaataaatttaggcagcacgattcggagcgt

SEQ ID NO: 20095 - DNA, 60 bp, Artificial Sequence
  Description of Artificial Sequence: Synthetic probe
atgaccctggagaaattaaggcctatgagttatgtaaggtattgtcaacggttggtcgga

SEQ ID NO: 20096 - DNA, 60 bp, Artificial Sequence
  Description of Artificial Sequence: Synthetic probe
gtgcacgctgaaaggagagatcggagtcaacccttccgacctggtgatcaaacattaatc

SEQ ID NO: 20097 - DNA, 60 bp, Artificial Sequence
  Description of Artificial Sequence: Synthetic probe
tacacacgagaacgatgttatggaatcacttagttcgtgttgagatgtcgcatgcagctc

SEQ ID NO: 20098 - DNA, 60 bp, Artificial Sequence
  Description of Artificial Sequence: Synthetic probe
gcgcactccttacataattgtgtggtgaaaattgattcaaagaaagcggatacaatgtct

SEQ ID NO: 20099 - DNA, 60 bp, Artificial Sequence
  Description of Artificial Sequence: Synthetic probe
gcggaccgctttatggtataaccctgtgagaaatgatggatttgtgctaccgcgagtgct

SEQ ID NO: 20100 - DNA, 60 bp, Artificial Sequence
  Description of Artificial Sequence: Synthetic probe
tgacgttacaaaattgcctgagatgaacgcctatgatatcaaatcggaaggcatgcggac

SEQ ID NO: 20101 - DNA, 60 bp, Artificial Sequence
  Description of Artificial Sequence: Synthetic probe
gactccagtacgaagatacaaagtgttggtgggcgccatgacgttacaaaattgcctgag

SEQ ID NO: 20102 - DNA, 60 bp, Artificial Sequence
  Description of Artificial Sequence: Synthetic probe
gcataccaatctacaaacgagggtttcctgagcatttgctgcacggttatgagtttacga

SEQ ID NO: 20103 - DNA, 60 bp, Artificial Sequence
  Description of Artificial Sequence: Synthetic probe
ggaagcgcgggtgaggagatcgggtgatgagaactggcagagctggctgttgcctatgat

SEQ ID NO: 20104 - DNA, 60 bp, Artificial Sequence
  Description of Artificial Sequence: Synthetic probe
ctgatgcgggagttggaactactggaacgaatggaggaagatgggtagttctaacagaag

SEQ ID NO: 20105 - DNA, 60 bp, Artificial Sequence
  Description of Artificial Sequence: Synthetic probe
gttctctagttggcaaccaccaaacatggagcgctttttgagaaaatacaacatcagtgg

SEQ ID NO: 20106 - DNA, 60 bp, Artificial Sequence
  Description of Artificial Sequence: Synthetic probe
ggggcaggggatgagattccagatccgttaagcccaggggaacgtggcatccagatgaag

SEQ ID NO: 20107 - DNA, 60 bp, Artificial Sequence
  Description of Artificial Sequence: Synthetic probe
cgcggtgaggatgaaatttaccagagtttcgtcaatcccgctagatgggttcgaaatgcc

SEQ ID NO: 20108 - DNA, 60 bp, Artificial Sequence
  Description of Artificial Sequence: Synthetic probe
atcttataatgacgcggtgaggatgaaatttaccagagtttcgtcaatcccgctagatgg

SEQ ID NO: 20109 - DNA, 60 bp, Artificial Sequence
  Description of Artificial Sequence: Synthetic probe
gagttgaagagctgagtctagtgcgtgttgatgataccatttctcaaccaccaaggtatg

SEQ ID NO: 20110 - DNA, 60 bp, Artificial Sequence
  Description of Artificial Sequence: Synthetic probe
acgtgcgatattgggcgcactcaaattcggagtgaaagtgcttggcgacaagattgatgt

SEQ ID NO: 20111 - DNA, 60 bp, Artificial Sequence
  Description of Artificial Sequence: Synthetic probe
aaaaggtcggaaatgcattgtcgtcaaacacagcgaagaaaatttattcaaccattggga

SEQ ID NO: 20112 - DNA, 60 bp, Artificial Sequence
  Description of Artificial Sequence: Synthetic probe
agagatcacacatggcatggactaagaacggcaatactaaatagaacaaccttaccaaat

SEQ ID NO: 20113 - DNA, 60 bp, Artificial Sequence
  Description of Artificial Sequence: Synthetic probe
aatgtatatagttttagagatcacacatggcatggactaagaacggcaatactaaataga

SEQ ID NO: 20114 - DNA, 60 bp, Artificial Sequence
  Description of Artificial Sequence: Synthetic probe
cagataggacgtatgatgtgggatggacaagcggttctgcagatacataatcctactcaa

SEQ ID NO: 20115 - DNA, 60 bp, Artificial Sequence
  Description of Artificial Sequence: Synthetic probe
cccgctagatggtttcgaattaccattaacctaagatcagtaggtagagtggcgccccaa

SEQ ID NO: 20116 - DNA, 60 bp, Artificial Sequence
  Description of Artificial Sequence: Synthetic probe
gtcccgctagatggtttcgaattaccattaacctaagatcagtaggtagagtggcgcccc

SEQ ID NO: 20117 - DNA, 60 bp, Artificial Sequence
  Description of Artificial Sequence: Synthetic probe
agtggctgctgtggttgcgctgctgacatcagtttgcaccctttcaagtgatatgagtgt

SEQ ID NO: 20118 - DNA, 60 bp, Artificial Sequence
  Description of Artificial Sequence: Synthetic probe
ggctacgattggtgtgctagcaacaccggaaataccttttacaacggaagcggcgaatga

SEQ ID NO: 20119 - DNA, 60 bp, Artificial Sequence
  Description of Artificial Sequence: Synthetic probe
acatatggctacgattggtgtgctagcaacaccggaaataccttttacaacggaagcggc

SEQ ID NO: 20120 - DNA, 60 bp, Artificial Sequence
  Description of Artificial Sequence: Synthetic probe
gcatatggctacgattggtgtgctagcaacaccggaaataccttttacaacggaagcggc

SEQ ID NO: 20121 - DNA, 60 bp, Artificial Sequence
  Description of Artificial Sequence: Synthetic probe
tctctcaaccaccaaggtatgctccgagtgcaccaatgccatcatctatgccaacggttg

SEQ ID NO: 20122 - DNA, 60 bp, Artificial Sequence
  Description of Artificial Sequence: Synthetic probe
cgtgtggatgatactatctctcaaccaccaaggtatgctccgagtgcaccgatgccatcg

SEQ ID NO: 20123 - DNA, 60 bp, Artificial Sequence
  Description of Artificial Sequence: Synthetic probe
ggctaagacagatcaaacgtcatgtcaatgaacagattctcccaaagttaaagagtgact

SEQ ID NO: 20124 - DNA, 58 bp, Artificial Sequence
  Description of Artificial Sequence: Synthetic probe
acataccactcttcttaagaaatgcttgaacgcagcgacgggaagcgcttacacttac

SEQ ID NO: 20125 - DNA, 60 bp, Artificial Sequence
  Description of Artificial Sequence: Synthetic probe
caagtgatatgagtgtagctttcaagataaatgggaccaaaacggaagtgccttcgtggt

SEQ ID NO: 20126 - DNA, 60 bp, Artificial Sequence
  Description of Artificial Sequence: Synthetic probe
ggcgcatcagaacgccgacccagtcgtgctagatgtgagctggatatcgctgtggtttgc

SEQ ID NO: 20127 - DNA, 58 bp, Artificial Sequence
  Description of Artificial Sequence: Synthetic probe
gatgtgccactcttcctcagaaacgcgtgactgcggtgatcccgggacttccacttac

SEQ ID NO: 20128 - DNA, 60 bp, Artificial Sequence
  Description of Artificial Sequence: Synthetic probe
ttgatgtgccactcttcctcagaaacgcgtgactgcggtgatcccgggacttccacttac

SEQ ID NO: 20129 - DNA, 60 bp, Artificial Sequence
  Description of Artificial Sequence: Synthetic probe
ggcgaaatgcgagaagaggcggagcaggaggaacagtataaggtgttgtgcaaagctgtc

SEQ ID NO: 20130 - DNA, 60 bp, Artificial Sequence
  Description of Artificial Sequence: Synthetic probe
ggtgaagtgcgagaagaggcggagcaggaggaacagtataaggtattgtgcaaagctgtt

SEQ ID NO: 20131 - DNA, 60 bp, Artificial Sequence
  Description of Artificial Sequence: Synthetic probe
gaatggtgaagtgcgagaagaggcggagcaggaggaacagtataaggtattgtgcaaagc

SEQ ID NO: 20132 - DNA, 60 bp, Artificial Sequence
  Description of Artificial Sequence: Synthetic probe
ggttcatacaatgatcggtgcggattaattgcgtacctggaatacatggttttctttccc

SEQ ID NO: 20133 - DNA, 60 bp, Artificial Sequence
  Description of Artificial Sequence: Synthetic probe
attagaagtgggttcatacaatgatcggtgcggattaattgcgtacctggaatacatggt

SEQ ID NO: 20134 - DNA, 60 bp, Artificial Sequence
  Description of Artificial Sequence: Synthetic probe
ctgcaatgtgtaggtgcgtgtgagcgtgttgcttttgtctctaaggacatgagcttaatc

SEQ ID NO: 20135 - DNA, 60 bp, Artificial Sequence
  Description of Artificial Sequence: Synthetic probe
agcagctagcagtaagtgtgttaaataagaagacagccgtaaccgataactgcaatgaaa

SEQ ID NO: 20136 - DNA, 54 bp, Artificial Sequence
  Description of Artificial Sequence: Synthetic probe
ggagcgatttgctgaaagcgaaatcggtgcggcaacaatagacggtttggtgca

SEQ ID NO: 20137 - DNA, 60 bp, Artificial Sequence
  Description of Artificial Sequence: Synthetic probe
agaatagtcgagcgagtgagagttggacaaatcttagctgtattgaataggagatttgtc

SEQ ID NO: 20138 - DNA, 60 bp, Artificial Sequence
  Description of Artificial Sequence: Synthetic probe
gtctttatcaataaaagaatagtcgagcgagtgagagttggacaaatcttagctgtattg

SEQ ID NO: 20139 - DNA, 60 bp, Artificial Sequence
  Description of Artificial Sequence: Synthetic probe
cttatacagtgttgagacccgaatttgtcatccatggcatcgctcccatcgttgggcaga

SEQ ID NO: 20140 - DNA, 60 bp, Artificial Sequence
  Description of Artificial Sequence: Synthetic probe
gatcacggcatgggatggacaggcggcgttaaacgttcataatccgacggcagcgaacgc

SEQ ID NO: 20141 - DNA, 60 bp, Artificial Sequence
  Description of Artificial Sequence: Synthetic probe
cgaccccagaagttccatttaccactgagtgtgcgaatgaggtcgcgcgtgttacaggcg

SEQ ID NO: 20142 - DNA, 53 bp, Artificial Sequence
  Description of Artificial Sequence: Synthetic probe
tgatgttgtccgccgcgggaattaacctcggccctatatcgccagattatcaa

SEQ ID NO: 20143 - DNA, 60 bp, Artificial Sequence
  Description of Artificial Sequence: Synthetic probe
tagtccactttgcacgggtgtgggttacacaggcggtgtgttggttgtggggagtgtgac

SEQ ID NO: 20144 - DNA, 60 bp, Artificial Sequence
  Description of Artificial Sequence: Synthetic probe
cgcgccgcttatgtgtagtccactttgcacgggtgtgggttacacaggcggtgtgttggt

SEQ ID NO: 20145 - DNA, 60 bp, Artificial Sequence
  Description of Artificial Sequence: Synthetic probe
cgctaacacgtgcaattgcgcgcgccgcttatgtgtagtccactttgcacgggtgtgggt

SEQ ID NO: 20146 - DNA, 60 bp, Artificial Sequence
  Description of Artificial Sequence: Synthetic probe
aatgaagacccttacgtgaagcgaacggtaaagcctatacgtgcggattgtatcgatctg

SEQ ID NO: 20147 - DNA, 60 bp, Artificial Sequence
  Description of Artificial Sequence: Synthetic probe
acttagaaggagagcctgcaacgaaggtattccactgggagtacgaattgattaataaag

SEQ ID NO: 20148 - DNA, 60 bp, Artificial Sequence
  Description of Artificial Sequence: Synthetic probe
cacaccgtacgaatcaagatcgtttctatgtgctgctaatgattgcggcgtcggacacaa

SEQ ID NO: 20149 - DNA, 60 bp, Artificial Sequence
  Description of Artificial Sequence: Synthetic probe
gtacgattgggaaggcagctgaaagattcgctgaaagtgaaattggatcagcagctatag

SEQ ID NO: 20150 - DNA, 60 bp, Artificial Sequence
  Description of Artificial Sequence: Synthetic probe
ctcgatgacattaaaacgttagctgcagaacaagtgtacaaaatcgtcaaagtacctaat

SEQ ID NO: 20151 - DNA, 60 bp, Artificial Sequence
  Description of Artificial Sequence: Synthetic probe
attctcgatgacattaaaacgttagctgcagaacaagtgtacaaaatcgtcaaagtacct

SEQ ID NO: 20152 - DNA, 60 bp, Artificial Sequence
  Description of Artificial Sequence: Synthetic probe
tagcggggatgactgctgatgtcttagaggcagcatctgaagaggtgcctctgatcggag

SEQ ID NO: 20153 - DNA, 60 bp, Artificial Sequence
  Description of Artificial Sequence: Synthetic probe
gatgtggggtgtcggagcagatccaatcgtcgtcttacaatctacggcgggtgatgatag

SEQ ID NO: 20154 - DNA, 60 bp, Artificial Sequence
  Description of Artificial Sequence: Synthetic probe
ctcggcgttggaattcggtgatgtaaggattgatccagttggactattgcgtgagttctt

SEQ ID NO: 20155 - DNA, 60 bp, Artificial Sequence
  Description of Artificial Sequence: Synthetic probe
catctcggcgttggaattcggtgatgtaaggattgatccagttggactattgcgtgagtt

SEQ ID NO: 20156 - DNA, 60 bp, Artificial Sequence
  Description of Artificial Sequence: Synthetic probe
cagatataatggattaactttacgaggggtgacgatgcgtccgacttcattggcgcagag

SEQ ID NO: 20157 - DNA, 60 bp, Artificial Sequence
  Description of Artificial Sequence: Synthetic probe
gggatagcaatcaacagatataatggattaactttacgaggggtgacgatgcgcccgacc

SEQ ID NO: 20158 - DNA, 60 bp, Artificial Sequence
  Description of Artificial Sequence: Synthetic probe
gcgggcaaagagactaaagatgcagaatgtgatagacgcatacatactgcagtgggatct

SEQ ID NO: 20159 - DNA, 60 bp, Artificial Sequence
  Description of Artificial Sequence: Synthetic probe
gatcaaaggatggtgagggacgcaatcggagagcggccagaaggaagagggcgggcaaag

SEQ ID NO: 20160 - DNA, 60 bp, Artificial Sequence
  Description of Artificial Sequence: Synthetic probe
gttcgtgaaggattggatcacccggatcggtgggaatggcttattgattacatggataga

SEQ ID NO: 20161 - DNA, 60 bp, Artificial Sequence
  Description of Artificial Sequence: Synthetic probe
cgttcgtgaaggattggatcacccggatcggtgggaatggcttattgattacatggatag

SEQ ID NO: 20162 - DNA, 60 bp, Artificial Sequence
  Description of Artificial Sequence: Synthetic probe
gcattacgatattacttatgaaacgttaaagacgaacgcgcagaagcttgtatatgacga

SEQ ID NO: 20163 - DNA, 60 bp, Artificial Sequence
  Description of Artificial Sequence: Synthetic probe
tcgatgcattacgatattacttatgaaacgttaaagacgaacgcgcagaagcttgtatat

SEQ ID NO: 20164 - DNA, 60 bp, Artificial Sequence
  Description of Artificial Sequence: Synthetic probe
atgcgaaggctgctgagaaaggaaggcgtaaacaggggaagaagcctcatggcgacgcgc

SEQ ID NO: 20165 - DNA, 60 bp, Artificial Sequence
  Description of Artificial Sequence: Synthetic probe
tggttgacctcgcggcgtaaattcccactgctgtataacgggggagggtacgcggcgcta

SEQ ID NO: 20166 - DNA, 60 bp, Artificial Sequence
  Description of Artificial Sequence: Synthetic probe
tatgtgccgatcaaagaaggtcaaattgtgaatccaacatttatatcaagatatcgccaa

SEQ ID NO: 20167 - DNA, 60 bp, Artificial Sequence
  Description of Artificial Sequence: Synthetic probe
ctatgtgccgatcaaagaaggtcaaattgtgaatccaacatttatatcaagatatcgcca

SEQ ID NO: 20168 - DNA, 60 bp, Artificial Sequence
  Description of Artificial Sequence: Synthetic probe
gccgccaattttcccgccaaacgatcgagatagcatcttaaccttacttctactgtctac

SEQ ID NO: 20169 - DNA, 60 bp, Artificial Sequence
  Description of Artificial Sequence: Synthetic probe
gcttacacgagtacgggaggagatgtgaaaacggaattcctgcatttgatcgatcacctc

SEQ ID NO: 20170 - DNA, 60 bp, Artificial Sequence
  Description of Artificial Sequence: Synthetic probe
agcttacacgagtacgggaggagatgtgaaaacggaattcctgcatttgatcgatcacct

SEQ ID NO: 20171 - DNA, 60 bp, Artificial Sequence
  Description of Artificial Sequence: Synthetic probe
gctgggaatttcgcgtgagggagtggccgagcagacagagagattgagagatctgcgacg

SEQ ID NO: 20172 - DNA, 60 bp, Artificial Sequence
  Description of Artificial Sequence: Synthetic probe
catccgcgtgtgatgatgaggttcaaaattcctagaacgcagcaaccgcaaatccacatt

SEQ ID NO: 20173 - DNA, 60 bp, Artificial Sequence
  Description of Artificial Sequence: Synthetic probe
gcggggtgcaactgctcgaggattaccgcaaaagtgggatgatggatgaggccgtgaagc

SEQ ID NO: 20174 - DNA, 60 bp, Artificial Sequence
  Description of Artificial Sequence: Synthetic probe
attggaattactatagagggggtcatgagccaaaagaaactgctaagcatgattggtggt

SEQ ID NO: 20175 - DNA, 60 bp, Artificial Sequence
  Description of Artificial Sequence: Synthetic probe
aggacgcaagcagaagaagagagctcatggtgacgcgcagagagagggcgtcgaggaaga

SEQ ID NO: 20176 - DNA, 60 bp, Artificial Sequence
  Description of Artificial Sequence: Synthetic probe
agctgttgagagaggaggacgcaagcagaagaagagagctcatggtgacgcgcagagaga

SEQ ID NO: 20177 - DNA, 51 bp, Artificial Sequence
  Description of Artificial Sequence: Synthetic probe
caaagttacgcttttgaggtgtacgtgaactcaattttgccgtggagtgaa

SEQ ID NO: 20178 - DNA, 60 bp, Artificial Sequence
  Description of Artificial Sequence: Synthetic probe
gtcaaacgttccaaagttacgcttttgaggtgtacgtgaactcaattttgccgtggagtg

SEQ ID NO: 20179 - DNA, 60 bp, Artificial Sequence
  Description of Artificial Sequence: Synthetic probe
gccaaacgttccaaagttacgcttttgaggtgtacgtgaactcaattttgccgtggagtg

SEQ ID NO: 20180 - DNA, 60 bp, Artificial Sequence
  Description of Artificial Sequence: Synthetic probe
gctcccgtcactacagccatcgctaaagctcgtattagaggaggaagcatgggctgcggc

SEQ ID NO: 20181 - DNA, 60 bp, Artificial Sequence
  Description of Artificial Sequence: Synthetic probe
cgcatcgtacgcagaagcgtttcgtgatgatgtgaggctgagacaaattaaacgacatgt

SEQ ID NO: 20182 - DNA, 60 bp, Artificial Sequence
  Description of Artificial Sequence: Synthetic probe
tttaatggtacatcagcggaaataccgccgtggtttaagagtctaaatcccatgcttgga

SEQ ID NO: 20183 - DNA, 60 bp, Artificial Sequence
  Description of Artificial Sequence: Synthetic probe
cttaatggtacatcagcggaaataccgccgtggtttaagagtttaaaccccatgcttgga

SEQ ID NO: 20184 - DNA, 60 bp, Artificial Sequence
  Description of Artificial Sequence: Synthetic probe
agtgtggcatttaaatttaatggtacatcagcggaaataccgccgtggtttaagagtcta

SEQ ID NO: 20185 - DNA, 60 bp, Artificial Sequence
  Description of Artificial Sequence: Synthetic probe
cgtgttaggtacaggtgaggagttgccagatccactgagccccggcgaacgtggtatcca

SEQ ID NO: 20186 - DNA, 60 bp, Artificial Sequence
  Description of Artificial Sequence: Synthetic probe
cttcactatgatgtttcgttcgcggatttgcgagggaatgctcaacggattgtgtatgat

SEQ ID NO: 20187 - DNA, 60 bp, Artificial Sequence
  Description of Artificial Sequence: Synthetic probe
cgagacgtttgatcagatcgaagaccgtacacccaatctacctgggatcgcttcactatg

SEQ ID NO: 20188 - DNA, 60 bp, Artificial Sequence
  Description of Artificial Sequence: Synthetic probe
atgaagatctgacagctcattggcacgcattgggcgcagcgcagatggcggtaggacgca

SEQ ID NO: 20189 - DNA, 60 bp, Artificial Sequence
  Description of Artificial Sequence: Synthetic probe
atttggttcactatgaagatctgacagctcattggcacgcattgggcgcagcgcagatgg

SEQ ID NO: 20190 - DNA, 60 bp, Artificial Sequence
  Description of Artificial Sequence: Synthetic probe
ttgcgtttcacaccaccatatgaatgaatcatttttcttaggatttgatctgagcatcga

SEQ ID NO: 20191 - DNA, 60 bp, Artificial Sequence
  Description of Artificial Sequence: Synthetic probe
cgaagagaaggaaatatgtggaatagaggataaggttatacatccgaaagttatgatgaa

SEQ ID NO: 20192 - DNA, 60 bp, Artificial Sequence
  Description of Artificial Sequence: Synthetic probe
gctctaagtgggattgatttaacacatctacggaccccgaagatagaaccaactgttgta

SEQ ID NO: 20193 - DNA, 60 bp, Artificial Sequence
  Description of Artificial Sequence: Synthetic probe
atgaccgccgatgtgttggaggcggcgtcggaagaagttcctctaataggagcggggatg

SEQ ID NO: 20194 - DNA, 60 bp, Artificial Sequence
  Description of Artificial Sequence: Synthetic probe
caagagatagctgggatgaccgccgatgtgttggaggcggcgtcggaagaagttcctcta

SEQ ID NO: 20195 - DNA, 60 bp, Artificial Sequence
  Description of Artificial Sequence: Synthetic probe
aataagatattagctgaagaagacttgcagatgcgacgacttgcaacggctttacagaag

SEQ ID NO: 20196 - DNA, 60 bp, Artificial Sequence
  Description of Artificial Sequence: Synthetic probe
tggagaagagttggaacaagtttacgatttcatgagtggggctgcaaaagaggaagctgg

SEQ ID NO: 20197 - DNA, 58 bp, Artificial Sequence
  Description of Artificial Sequence: Synthetic probe
tgaatcatatggtgaatcggttaaacaggctgtgctattaaacgtgctaggtagcggt

SEQ ID NO: 20198 - DNA, 60 bp, Artificial Sequence
  Description of Artificial Sequence: Synthetic probe
cggaggcgtatcgtgaatttctcaatctatcaatctcaaacacgtatagtagcgctatac

SEQ ID NO: 20199 - DNA, 60 bp, Artificial Sequence
  Description of Artificial Sequence: Synthetic probe
cggaggcgtatcgtgaatttctcaatctatcaatttcaagcacgtatagcagcgcgatac

SEQ ID NO: 20200 - DNA, 60 bp, Artificial Sequence
  Description of Artificial Sequence: Synthetic probe
aacggaggcgtatcgtgaatttctcaatctatcaatctcacacacgtatagcagcgccat

SEQ ID NO: 20201 - DNA, 60 bp, Artificial Sequence
  Description of Artificial Sequence: Synthetic probe
tccaccatattttaacaaatggacgcacgctccaatgtttaatgcaaaagtgaaaccatg

SEQ ID NO: 20202 - DNA, 60 bp, Artificial Sequence
  Description of Artificial Sequence: Synthetic probe
attaataaagtgtatcagataacaaatcatacggggaatcattgtgatttgtatcctgac

SEQ ID NO: 20203 - DNA, 60 bp, Artificial Sequence
  Description of Artificial Sequence: Synthetic probe
ttatgtgttgctaatgattgcggcgtcggacacaaataatggcagagtatggtggtcaaa

SEQ ID NO: 20204 - DNA, 60 bp, Artificial Sequence
  Description of Artificial Sequence: Synthetic probe
ctcaaagagtgaaagagctctgaaccagcagatagatatgataaagaaggaagtgatgaa

SEQ ID NO: 20205 - DNA, 60 bp, Artificial Sequence
  Description of Artificial Sequence: Synthetic probe
ccggatctacatgaaggtatggaacatcaagcatatgtgcatccgtcgactggtgggacg

SEQ ID NO: 20206 - DNA, 60 bp, Artificial Sequence
  Description of Artificial Sequence: Synthetic probe
tccggatctacatgaaggtatggaacatcaagcatatgtgcatccgtcgactggtgggac

SEQ ID NO: 20207 - DNA, 60 bp, Artificial Sequence
  Description of Artificial Sequence: Synthetic probe
ccgagttagttttgccggattatttcgataaatggatcagttcaccaatgtttaacgcgc

SEQ ID NO: 20208 - DNA, 60 bp, Artificial Sequence
  Description of Artificial Sequence: Synthetic probe
tgaagagccgaaagatgaaatggatctatcgacaagatttcagttcaaacttgacgaaaa

SEQ ID NO: 20209 - DNA, 60 bp, Artificial Sequence
  Description of Artificial Sequence: Synthetic probe
atgaagagccgaaagatgaaatggatctatcgacaagatttcagttcaaacttgacgaaa

SEQ ID NO: 20210 - DNA, 60 bp, Artificial Sequence
  Description of Artificial Sequence: Synthetic probe
aggaacgcgaataggcaatagtggattaacctatgaacggttcatttcgagcatggtcca

SEQ ID NO: 20211 - DNA, 60 bp, Artificial Sequence
  Description of Artificial Sequence: Synthetic probe
attggaattactatagaaggggtcatgagtcaaaagaaactactaagcatgattggtggt

SEQ ID NO: 20212 - DNA, 60 bp, Artificial Sequence
  Description of Artificial Sequence: Synthetic probe
agccggcacgcattggaattactatagaaggggtcatgagtcaaaagaaactgctaagca

SEQ ID NO: 20213 - DNA, 60 bp, Artificial Sequence
  Description of Artificial Sequence: Synthetic probe
agccgttgagagaggaggacgcaagcagaggaagaaagcccatggcgacgcgcacagaga

SEQ ID NO: 20214 - DNA, 60 bp, Artificial Sequence
  Description of Artificial Sequence: Synthetic probe
agccgttgagagaggaggacgcaagcagaggaagaaagcccatggcgacgcgcagagaga

SEQ ID NO: 20215 - DNA, 60 bp, Artificial Sequence
  Description of Artificial Sequence: Synthetic probe
tgaagaactgaggttagtgcgtgtggatgataccatttctcaaccaccaaggtatgctcc

SEQ ID NO: 20216 - DNA, 60 bp, Artificial Sequence
  Description of Artificial Sequence: Synthetic probe
cctcgggaagttgcaagaagtcatgatatgaaagcttttgaaaatgagatcggcagacgc

SEQ ID NO: 20217 - DNA, 60 bp, Artificial Sequence
  Description of Artificial Sequence: Synthetic probe
acggcgtaaatccgatgccagggccgctcacacgtgctattgcacgcgccgcctatgtgt

SEQ ID NO: 20218 - DNA, 60 bp, Artificial Sequence
  Description of Artificial Sequence: Synthetic probe
ccatggcatgtgagaaatgatctgattcgtgcgctaagggaatacaaacggaaaatgggg

SEQ ID NO: 20219 - DNA, 60 bp, Artificial Sequence
  Description of Artificial Sequence: Synthetic probe
ccatggcatgtgagaaatgatctgactcgtgcgctaagggaatacaaacggaaaatgggg

SEQ ID NO: 20220 - DNA, 60 bp, Artificial Sequence
  Description of Artificial Sequence: Synthetic probe
ccagattccaattaattacagctttcacctctttaaaaacattgcttctcgcttcacgta

SEQ ID NO: 20221 - DNA, 60 bp, Artificial Sequence
  Description of Artificial Sequence: Synthetic probe
gtgctaggtacaggcgaagaattaccagacccactgagccccggcgagcgtggtatgcaa

SEQ ID NO: 20222 - DNA, 60 bp, Artificial Sequence
  Description of Artificial Sequence: Synthetic probe
cgatacacggcgtaaatccaatgcccggcccgcttacacgtgcgattgcgcgcgccgctt

SEQ ID NO: 20223 - DNA, 60 bp, Artificial Sequence
  Description of Artificial Sequence: Synthetic probe
tttactgtctactttagcggatgtgtatactgttcttcgacccgaattcgcgatacacgg

SEQ ID NO: 20224 - DNA, 60 bp, Artificial Sequence
  Description of Artificial Sequence: Synthetic probe
ctaccaccaatcttcccaccaaacgatcgagatagcatcttaaccttacttttactgtct

SEQ ID NO: 20225 - DNA, 60 bp, Artificial Sequence
  Description of Artificial Sequence: Synthetic probe
ctgcgatcttgaagagaaccactttaccaaatatgctaccaccaatcttcccaccaaacg

SEQ ID NO: 20226 - DNA, 59 bp, Artificial Sequence
  Description of Artificial Sequence: Synthetic probe
atggacaagaccttaaaccaatatccgtctctaacggcagagattttcaacgtgtatag

SEQ ID NO: 20227 - DNA, 60 bp, Artificial Sequence
  Description of Artificial Sequence: Synthetic probe
cgacacagcagaatgcgatggttcaaattcaggtggttttttacatttcgatggacaaga

SEQ ID NO: 20228 - DNA, 57 bp, Artificial Sequence
  Description of Artificial Sequence: Synthetic probe
attgagaactttgctatgccccaaggtaattcgcagcaaacgctagctggcgttact

SEQ ID NO: 20229 - DNA, 60 bp, Artificial Sequence
  Description of Artificial Sequence: Synthetic probe
ccagggtcgtaatgatcccatgatgatatatctagtttggagaaggattgagaactttgc

SEQ ID NO: 20230 - DNA, 60 bp, Artificial Sequence
  Description of Artificial Sequence: Synthetic probe
tgttccagggtcgtaatgatcccatgatgatatatctagtttggagaaggattgagaact

SEQ ID NO: 20231 - DNA, 60 bp, Artificial Sequence
  Description of Artificial Sequence: Synthetic probe
ggtttatgcgagctgcacaggcggtaacggccgttgtgtgtggacctgacatgatacaag

SEQ ID NO: 20232 - DNA, 56 bp, Artificial Sequence
  Description of Artificial Sequence: Synthetic probe
ttcaacatggggccctgcgcgccaaccgtatggttttttcttagaaacggaagagg

SEQ ID NO: 20233 - DNA, 60 bp, Artificial Sequence
  Description of Artificial Sequence: Synthetic probe
ccattcacaactgaggcagcaaatgaaatcgcacgtgttacgggtgaaacttcaacatgg

SEQ ID NO: 20234 - DNA, 56 bp, Artificial Sequence
  Description of Artificial Sequence: Synthetic probe
gaaatgtttttcatgtgcttagatatgatgttgtcagcagcagggattaatgtggg

SEQ ID NO: 20235 - DNA, 60 bp, Artificial Sequence
  Description of Artificial Sequence: Synthetic probe
tgcgtggagttacgatgagacccacatcattagcgcagaggaatgaaatgtttttcatgt

SEQ ID NO: 20236 - DNA, 60 bp, Artificial Sequence
  Description of Artificial Sequence: Synthetic probe
gggcattgcaattaacagatataatggattaacattgcgtggagttacgatgagacccac

SEQ ID NO: 20237 - DNA, 60 bp, Artificial Sequence
  Description of Artificial Sequence: Synthetic probe
gatggaaatattgggcattgcaattaacagatataatggattaacattgcgtggagttac

SEQ ID NO: 20238 - DNA, 60 bp, Artificial Sequence
  Description of Artificial Sequence: Synthetic probe
agcaaatgtgatggaaatattgggcattgcaattaacagatataatggattaacattgcg

SEQ ID NO: 20239 - DNA, 60 bp, Artificial Sequence
  Description of Artificial Sequence: Synthetic probe
gttaaaaatctatagagatggacactatcgcggcaagagcactcactgtaatgcgggcat

SEQ ID NO: 20240 - DNA, 60 bp, Artificial Sequence
  Description of Artificial Sequence: Synthetic probe
gttaaaaatctatagagatggacactatcgcggcaagagcacttactgtaatgcgggcat

SEQ ID NO: 20241 - DNA, 60 bp, Artificial Sequence
  Description of Artificial Sequence: Synthetic probe
tgggtcaggtttggcggtgtgctacgcactgtacgcgttaaattcttcgatgcacggccc

SEQ ID NO: 20242 - DNA, 60 bp, Artificial Sequence
  Description of Artificial Sequence: Synthetic probe
gggtaagatttggcggtgtgctacgcactgtacgcgttaaattcttcgatgcacgacccc

SEQ ID NO: 20243 - DNA, 60 bp, Artificial Sequence
  Description of Artificial Sequence: Synthetic probe
ctgggtaagatttggcggtgtgctacgcactgtacgcgttaaattcttcgatgcacgacc

SEQ ID NO: 20244 - DNA, 60 bp, Artificial Sequence
  Description of Artificial Sequence: Synthetic probe
gggtcaggtttggcggtgtgctacgcactgtacgcgttaaattcttcgatgcacggcccc

SEQ ID NO: 20245 - DNA, 60 bp, Artificial Sequence
  Description of Artificial Sequence: Synthetic probe
gaccccgagcgcctgaagatatttgagcatgggaatcaacgtagagatgaggatcggttc

SEQ ID NO: 20246 - DNA, 60 bp, Artificial Sequence
  Description of Artificial Sequence: Synthetic probe
acttatgacatcgtggtccacgctgaaaggagagatcgcagtcaaccgtttaggccgggg

SEQ ID NO: 20247 - DNA, 60 bp, Artificial Sequence
  Description of Artificial Sequence: Synthetic probe
cagctgtgttacttgaaacactcaaagcagatcccgacctgtggcgtgattgatgtacgc

SEQ ID NO: 20248 - DNA, 60 bp, Artificial Sequence
  Description of Artificial Sequence: Synthetic probe
cgcttacatactacagtgggatctggatcaagcgcaaaaggatctggagaacgcgcggac

SEQ ID NO: 20249 - DNA, 60 bp, Artificial Sequence
  Description of Artificial Sequence: Synthetic probe
gacgcatacatactacagtgggatctggatcaagcgcaaaaggatctggagaacgcgcga

SEQ ID NO: 20250 - DNA, 60 bp, Artificial Sequence
  Description of Artificial Sequence: Synthetic probe
caaatgtggatagacgcttacatactacagtgggatctggatcaagcgcaaaaggatctg

SEQ ID NO: 20251 - DNA, 60 bp, Artificial Sequence
  Description of Artificial Sequence: Synthetic probe
tgcagatgtggatagacgcatacatactacagtgggatctggatcaagcgcaaaaggatc

SEQ ID NO: 20252 - DNA, 60 bp, Artificial Sequence
  Description of Artificial Sequence: Synthetic probe
cagaaggcggagaaagctgcattcgcatcgtacgcagaagcgtttcgtgatgatgtgaga

SEQ ID NO: 20253 - DNA, 60 bp, Artificial Sequence
  Description of Artificial Sequence: Synthetic probe
acacagaaggcggagaaagctgcattcgcatcgtacgcagaagcgtttcgtgatgatgtg

SEQ ID NO: 20254 - DNA, 60 bp, Artificial Sequence
  Description of Artificial Sequence: Synthetic probe
acacagaaggcggagaaagctgcattcgcatcgtacgcagaagcgtttcgtgatgatgta

SEQ ID NO: 20255 - DNA, 50 bp, Artificial Sequence
  Description of Artificial Sequence: Synthetic probe
cgccgcgcgcggatgggacaataccggattggaataacctcggaagtttt

SEQ ID NO: 20256 - DNA, 60 bp, Artificial Sequence
  Description of Artificial Sequence: Synthetic probe
acaaatcaggaatccgctcgctttatatgtgcccataggctggaatggttatggcgcgca

SEQ ID NO: 20257 - DNA, 60 bp, Artificial Sequence
  Description of Artificial Sequence: Synthetic probe
ggaaagaagaacctggcgtcctgacctttctgtcggagcaatatgtcggtgatgatacgc

SEQ ID NO: 20258 - DNA, 60 bp, Artificial Sequence
  Description of Artificial Sequence: Synthetic probe
gtggaatgggaaacgccggttatttaggacgacattcgatgcctacctacggttagacga

SEQ ID NO: 20259 - DNA, 60 bp, Artificial Sequence
  Description of Artificial Sequence: Synthetic probe
ccaaagccatgcgttcgaggtctacatcaattcgattttaccgtggagtgaacttgatcc

SEQ ID NO: 20260 - DNA, 51 bp, Artificial Sequence
  Description of Artificial Sequence: Synthetic probe
ttgagcataggtttaaagatataccagatgaacaattggccattagcgtat

SEQ ID NO: 20261 - DNA, 60 bp, Artificial Sequence
  Description of Artificial Sequence: Synthetic probe
aatgtgttgggtacaggcgaagaattgccagatcccctcagccctggtgagcgcggcatg

SEQ ID NO: 20262 - DNA, 60 bp, Artificial Sequence
  Description of Artificial Sequence: Synthetic probe
gaatgtgttgggtacaggcgaagaattgccagatcccctcagccctggtgagcgcggcat

SEQ ID NO: 20263 - DNA, 60 bp, Artificial Sequence
  Description of Artificial Sequence: Synthetic probe
gaaaaagatttactcgacgattggaaaagcagcagaacgttttgcagaaagtgaaatagg

SEQ ID NO: 20264 - DNA, 60 bp, Artificial Sequence
  Description of Artificial Sequence: Synthetic probe
cttagtcgttttgggaaaaaggtcgggaatgctttgacgtcgaatacagcgaaaaagatt

SEQ ID NO: 20265 - DNA, 60 bp, Artificial Sequence
  Description of Artificial Sequence: Synthetic probe
atgagaattatggacatcactcaatcgctcaagatgggcaccaagctggctgcgccaact

SEQ ID NO: 20266 - DNA, 60 bp, Artificial Sequence
  Description of Artificial Sequence: Synthetic probe
cgcttactcagcgaattacgacgaccgggccctttgcgatattgactggatcaacgccaa

SEQ ID NO: 20267 - DNA, 60 bp, Artificial Sequence
  Description of Artificial Sequence: Synthetic probe
gtttatgagtctatcaagcgctatgcctcaggcgagcggtggatttgatcgtatgattgt

SEQ ID NO: 20268 - DNA, 60 bp, Artificial Sequence
  Description of Artificial Sequence: Synthetic probe
atctagatgagaaggatgaagagggtagagatgagcgggaggatgaggagcaggtgaaga

SEQ ID NO: 20269 - DNA, 60 bp, Artificial Sequence
  Description of Artificial Sequence: Synthetic probe
ttaaaattggaagagtgatagcttttaaacctgttaagaatccggaacccaagggatacg

SEQ ID NO: 20270 - DNA, 60 bp, Artificial Sequence
  Description of Artificial Sequence: Synthetic probe
aaccgtattgtcagattaaaattggaagagtgatagcttttaaacctgttaagaatccgg

SEQ ID NO: 20271 - DNA, 60 bp, Artificial Sequence
  Description of Artificial Sequence: Synthetic probe
tgaacctacgcataggaatgagatgctcgagattgctccgctgatcgaatccgtttatgc

SEQ ID NO: 20272 - DNA, 60 bp, Artificial Sequence
  Description of Artificial Sequence: Synthetic probe
ccattaacctaagatcagtaggtagagtggcgccccaaggtttgcatcatgtggagtggt

SEQ ID NO: 20273 - DNA, 60 bp, Artificial Sequence
  Description of Artificial Sequence: Synthetic probe
ccattaacctaagatcagtaggtagagtggcgccccaaggtttgtatcgtatgaagtggt

SEQ ID NO: 20274 - DNA, 60 bp, Artificial Sequence
  Description of Artificial Sequence: Synthetic probe
cgctagatggtttcgaactaccattaacctaagatcagtaggtagagtggcgccccgagg

SEQ ID NO: 20275 - DNA, 60 bp, Artificial Sequence
  Description of Artificial Sequence: Synthetic probe
cccgcttgatggtttcgagctaccattaacctaagatcagtaggtagagtggcgccccga

SEQ ID NO: 20276 - DNA, 60 bp, Artificial Sequence
  Description of Artificial Sequence: Synthetic probe
cccgctagatggtttcgaactaccattaacctaagatcagtaggtagagtggcgccccga

SEQ ID NO: 20277 - DNA, 60 bp, Artificial Sequence
  Description of Artificial Sequence: Synthetic probe
gtcccgctagatggtttcgaactgccgttaacctaagatcagtaggtagagtggcgcccc

SEQ ID NO: 20278 - DNA, 60 bp, Artificial Sequence
  Description of Artificial Sequence: Synthetic probe
ggcgagatcgcaacccggaaggtggatgacccttggaacaatcgagcggttcatgggtac

SEQ ID NO: 20279 - DNA, 60 bp, Artificial Sequence
  Description of Artificial Sequence: Synthetic probe
ggtcgcgtgtggaggacgaatccttatccgtgtctacgcggtgcgctaattgctgctgag

SEQ ID NO: 20280 - DNA, 60 bp, Artificial Sequence
  Description of Artificial Sequence: Synthetic probe
agagatgaaggggatagagatgaacgggaggatgaggagcaagtgaaggccttaagtgac

SEQ ID NO: 20281 - DNA, 60 bp, Artificial Sequence
  Description of Artificial Sequence: Synthetic probe
agagatgaacgggaggatgaggagcaagtgaaggccttaagtgacgatgatgaccaaggc

SEQ ID NO: 20282 - DNA, 60 bp, Artificial Sequence
  Description of Artificial Sequence: Synthetic probe
cgcatcctcgccttggtcatcatcgtcacttaaggccttcacttgctcctcatcctcccg

SEQ ID NO: 20283 - DNA, 60 bp, Artificial Sequence
  Description of Artificial Sequence: Synthetic probe
ccactctattggtagctgctgtggttgcgctgttgacatcagtttgcaccctatcaagcg

SEQ ID NO: 20284 - DNA, 60 bp, Artificial Sequence
  Description of Artificial Sequence: Synthetic probe
gcggttaattcatataataagatattagctgaagaagacttgcagatgcggcgacttgcg

SEQ ID NO: 20285 - DNA, 60 bp, Artificial Sequence
  Description of Artificial Sequence: Synthetic probe
ctgattcaatcgtttacacgctgccggttgcgcatccgaaaaaatgtatcgttctaatcg

SEQ ID NO: 20286 - DNA, 60 bp, Artificial Sequence
  Description of Artificial Sequence: Synthetic probe
aattatggacattacgcaatcgctcaaaatgggcactaagctggctgcgccgactgtgta

SEQ ID NO: 20287 - DNA, 60 bp, Artificial Sequence
  Description of Artificial Sequence: Synthetic probe
tgagaattatggacattacgcaatcgctcaaaatgggcactaagctggctgcgccgactg

SEQ ID NO: 20288 - DNA, 60 bp, Artificial Sequence
  Description of Artificial Sequence: Synthetic probe
cggtgcggggtgcaactgctcgaagattaccgcaaaagtgggatgatggatgaggccgtg

SEQ ID NO: 20289 - DNA, 60 bp, Artificial Sequence
  Description of Artificial Sequence: Synthetic probe
cagatcatcgaggtggaacgcagtctccagaaagagctggggatttcgcgtgagggagtg

SEQ ID NO: 20290 - DNA, 60 bp, Artificial Sequence
  Description of Artificial Sequence: Synthetic probe
cgcccgacctcgttagcacatagaaatgagatgctttttatgtgtttggatatgatgctg

SEQ ID NO: 20291 - DNA, 60 bp, Artificial Sequence
  Description of Artificial Sequence: Synthetic probe
gccacgagcggatctgttttatttgaccaatcggtgcaacatgggattggagcctagtat

SEQ ID NO: 20292 - DNA, 60 bp, Artificial Sequence
  Description of Artificial Sequence: Synthetic probe
gaaccacgagcagatctgttttatttgaccaatcggtgcaacatgggattggaaccaagc

SEQ ID NO: 20293 - DNA, 60 bp, Artificial Sequence
  Description of Artificial Sequence: Synthetic probe
gaaccacgagcagatctgttttatttgaccaatcggtgcaacatgggattggagccaagc

SEQ ID NO: 20294 - DNA, 60 bp, Artificial Sequence
  Description of Artificial Sequence: Synthetic probe
gaaccacgagcagatctgttttatttgaccaatcggtgcaacatgggactggaaccaagc

SEQ ID NO: 20295 - DNA, 60 bp, Artificial Sequence
  Description of Artificial Sequence: Synthetic probe
atgaaccacgagcagatctgttttatttgaccaatcggtgcaacatgggactggaaccaa

SEQ ID NO: 20296 - DNA, 60 bp, Artificial Sequence
  Description of Artificial Sequence: Synthetic probe
atgaaccacgagcagatctgttttatttgaccaatcggtgcaacatgggattggagccaa

SEQ ID NO: 20297 - DNA, 60 bp, Artificial Sequence
  Description of Artificial Sequence: Synthetic probe
gtgatgaaccacgagcagatctgttttatttgaccaatcggtgcaacatgggattggaac

SEQ ID NO: 20298 - DNA, 60 bp, Artificial Sequence
  Description of Artificial Sequence: Synthetic probe
atgcgcggcgtatgattagatcaaaaactgtgcaccccatttatttaggctcgatgcatt

SEQ ID NO: 20299 - DNA, 60 bp, Artificial Sequence
  Description of Artificial Sequence: Synthetic probe
ctagtgggatcgggaatggcaacggctattgcaacaggtagagcgatcgagggcgcgtac

SEQ ID NO: 20300 - DNA, 60 bp, Artificial Sequence
  Description of Artificial Sequence: Synthetic probe
aagaagttcctctagtgggatcgggaatggcaacggctattgcaacaggtagagcgatcg

SEQ ID NO: 20301 - DNA, 60 bp, Artificial Sequence
  Description of Artificial Sequence: Synthetic probe
ggcggcttcggaagaagttcctctagtaggatcgggaatggcaacggctattgcaacagg

SEQ ID NO: 20302 - DNA, 60 bp, Artificial Sequence
  Description of Artificial Sequence: Synthetic probe
aaaacgaatcgaagatggttaaagaatataggcagaaaatagatgccttaaaggttgcaa

SEQ ID NO: 20303 - DNA, 60 bp, Artificial Sequence
  Description of Artificial Sequence: Synthetic probe
agagagaaatttggtgaacaattggaggaaatataccaattcatgaacggcgaagttaag

SEQ ID NO: 20304 - DNA, 60 bp, Artificial Sequence
  Description of Artificial Sequence: Synthetic probe
tacggaaaagaaataagagagaaatttggtgaacaattggaggaaatataccaattcatg

SEQ ID NO: 20305 - DNA, 60 bp, Artificial Sequence
  Description of Artificial Sequence: Synthetic probe
gagtttagtgcgtgtcgatgataccatttctcaaccaccgaggtatgctccgagtgcgcc

SEQ ID NO: 20306 - DNA, 60 bp, Artificial Sequence
  Description of Artificial Sequence: Synthetic probe
gagttgaggagctgagtttagtgcgtgtcgatgataccatttctcaaccaccgaggtatg

SEQ ID NO: 20307 - DNA, 60 bp, Artificial Sequence
  Description of Artificial Sequence: Synthetic probe
taagatttggtggtgttttacgaacggttcgcgtcaaattctacgatgcacgacctccgg

SEQ ID NO: 20308 - DNA, 60 bp, Artificial Sequence
  Description of Artificial Sequence: Synthetic probe
attgggtaagatttggtggtgttttacgaacggttcgcgttaaattttatgatgcgcgac

SEQ ID NO: 20309 - DNA, 60 bp, Artificial Sequence
  Description of Artificial Sequence: Synthetic probe
tgactgggtaagatttggtggtgttttacgaacggttcgcgttaagttctatgacgcgcg

SEQ ID NO: 20310 - DNA, 50 bp, Artificial Sequence
  Description of Artificial Sequence: Synthetic probe
gggccagcgcgtcagccttatggtttcttccttgaaactgaggaaacctt

SEQ ID NO: 20311 - DNA, 51 bp, Artificial Sequence
  Description of Artificial Sequence: Synthetic probe
cggttgtgggatatatgtaacccattcaaacgtctcttagattacacttac

SEQ ID NO: 20312 - DNA, 52 bp, Artificial Sequence
  Description of Artificial Sequence: Synthetic probe
tcggttgtgggatatatgtaacccattcaaacgtctcttagattacacttac

SEQ ID NO: 20313 - DNA, 60 bp, Artificial Sequence
  Description of Artificial Sequence: Synthetic probe
gcggcggttgttgctatgttgacatcagtctgcacgttatcgagtgatatgagcgtggcg

SEQ ID NO: 20314 - DNA, 60 bp, Artificial Sequence
  Description of Artificial Sequence: Synthetic probe
cattactgatagcggcggttgttgctatgttgacatcagtctgcacgttatcgagtgata

SEQ ID NO: 20315 - DNA, 60 bp, Artificial Sequence
  Description of Artificial Sequence: Synthetic probe
gcagcggttgttgctctattgacatcagtctgcaccttatcgagtgatatgagcgtggcg

SEQ ID NO: 20316 - DNA, 60 bp, Artificial Sequence
  Description of Artificial Sequence: Synthetic probe
ctgatagcagcggttgttgctctattgacatcagtctgcaccttatcgagtgatatgagc

SEQ ID NO: 20317 - DNA, 60 bp, Artificial Sequence
  Description of Artificial Sequence: Synthetic probe
taatcaggaacgggtagaagagctgagtctagtccgtgtggatgacacgatttcccaacc

SEQ ID NO: 20318 - DNA, 60 bp, Artificial Sequence
  Description of Artificial Sequence: Synthetic probe
tgcattcgcatcgtacgcggaagcgtttcgtgatgatgtgaggctgagacaaattaaacg

SEQ ID NO: 20319 - DNA, 60 bp, Artificial Sequence
  Description of Artificial Sequence: Synthetic probe
gagaggacccctacattttcagcgacgtgcgatattgggcgcgctcaaattcggagtgaa

SEQ ID NO: 20320 - DNA, 60 bp, Artificial Sequence
  Description of Artificial Sequence: Synthetic probe
cgaggcgtatgattagatcaaagacagttcatcccatctacctaggatccatgcattatg

SEQ ID NO: 20321 - DNA, 60 bp, Artificial Sequence
  Description of Artificial Sequence: Synthetic probe
gaggttcaaggttccacgatcgcagcagccccaaattcatatctacagcgcgccatggga

SEQ ID NO: 20322 - DNA, 60 bp, Artificial Sequence
  Description of Artificial Sequence: Synthetic probe
gagtaatgatgaggttcaaggttccacgatcgcagcagccccaaattcatatctacagcg

SEQ ID NO: 20323 - DNA, 60 bp, Artificial Sequence
  Description of Artificial Sequence: Synthetic probe
cgatggttgcaactactttagaacatagattcagagatataccagataaagaactagctg

SEQ ID NO: 20324 - DNA, 60 bp, Artificial Sequence
  Description of Artificial Sequence: Synthetic probe
agaaccgacgatggttgcaactactttagaacatagattcagagatataccagataaaga

SEQ ID NO: 20325 - DNA, 60 bp, Artificial Sequence
  Description of Artificial Sequence: Synthetic probe
cggaatagatctctcgcatttgcgaaccccgaagatagaaccgacgatggttgcaactac

SEQ ID NO: 20326 - DNA, 60 bp, Artificial Sequence
  Description of Artificial Sequence: Synthetic probe
ataaacgcattaagcggaatagatctctcgcatttgcgaaccccgaagatagaaccgacg

SEQ ID NO: 20327 - DNA, 60 bp, Artificial Sequence
  Description of Artificial Sequence: Synthetic probe
ggagagagttgaagagctaagtctggttcgtgtggatgatacaatttcacaaccaccgag

SEQ ID NO: 20328 - DNA, 60 bp, Artificial Sequence
  Description of Artificial Sequence: Synthetic probe
cactactctactagtggctgctgtggttgcgctgctgacatcagtttgcaccctttcaag

SEQ ID NO: 20329 - DNA, 60 bp, Artificial Sequence
  Description of Artificial Sequence: Synthetic probe
gatgtaagttggatttcgctttggtttgcctttaatcggtcgtttgagccaacgcatcgt

SEQ ID NO: 20330 - DNA, 60 bp, Artificial Sequence
  Description of Artificial Sequence: Synthetic probe
aaagtgtacccttagcgaagatgggtaaagtcatacgatctctaagccgattcggcaaaa

SEQ ID NO: 20331 - DNA, 60 bp, Artificial Sequence
  Description of Artificial Sequence: Synthetic probe
aaaagtgtacccttagcgaagatgggtaaagtcatacgatctctaagccgattcggaaaa

SEQ ID NO: 20332 - DNA, 60 bp, Artificial Sequence
  Description of Artificial Sequence: Synthetic probe
gggcgcactcaaattcggagtgaaagtgcttggcgacaagattgatgtgccactctttct

SEQ ID NO: 20333 - DNA, 56 bp, Artificial Sequence
  Description of Artificial Sequence: Synthetic probe
agtgggttcaggaatggcgacggccatagcaacgggacgagcgattgaaggtgcat

SEQ ID NO: 20334 - DNA, 60 bp, Artificial Sequence
  Description of Artificial Sequence: Synthetic probe
gcgggtatgacagctgacgtattggaagcagcttctgaagaagtaccgttagtaggttca

SEQ ID NO: 20335 - DNA, 60 bp, Artificial Sequence
  Description of Artificial Sequence: Synthetic probe
gcgggtatgacagctgacgtattggaagcagcttctgaagaggtaccgttagtgggttca

SEQ ID NO: 20336 - DNA, 60 bp, Artificial Sequence
  Description of Artificial Sequence: Synthetic probe
tttgctgagagtgagatcggatcagccgcgatcgatgggctagttcaaggcagtgtgcac

SEQ ID NO: 20337 - DNA, 55 bp, Artificial Sequence
  Description of Artificial Sequence: Synthetic probe
cgcgaaagatgggcaaaataatcaaatcgctaagccgttttggcaaaaaagtggg

SEQ ID NO: 20338 - DNA, 60 bp, Artificial Sequence
  Description of Artificial Sequence: Synthetic probe
ggaactactggaaggaatggaggaagatgggtagttctaacggaagagattgctcgcgcg

SEQ ID NO: 20339 - DNA, 60 bp, Artificial Sequence
  Description of Artificial Sequence: Synthetic probe
ggagctgctggagcgaatggaggaagatgggtagttctaacggaagagattgctcgcgcg

SEQ ID NO: 20340 - DNA, 60 bp, Artificial Sequence
  Description of Artificial Sequence: Synthetic probe
ctgatgcgggagttggaactactggaaggaatggaggaagatgggtagttctaacggaag

SEQ ID NO: 20341 - DNA, 60 bp, Artificial Sequence
  Description of Artificial Sequence: Synthetic probe
ctgatgcgggagttggagctgctggagcgaatggaggaagatgggtagttctaacggaag

SEQ ID NO: 20342 - DNA, 60 bp, Artificial Sequence
  Description of Artificial Sequence: Synthetic probe
aagtaccattagtgggatcggggatggcaaccgccatagcgaccggacgagcgatagagg

SEQ ID NO: 20343 - DNA, 60 bp, Artificial Sequence
  Description of Artificial Sequence: Synthetic probe
tctaggaatggagatgtaacgacgcattcgcagggtattgttaaagttgagctgttaaaa

SEQ ID NO: 20344 - DNA, 60 bp, Artificial Sequence
  Description of Artificial Sequence: Synthetic probe
tgctcgatgatgcggaaaaagttgtagcggttgaaatgctgaattactatatgcgtaccg

SEQ ID NO: 20345 - DNA, 60 bp, Artificial Sequence
  Description of Artificial Sequence: Synthetic probe
cctcttagttgatttcttctttgaacgaaggagcgtgttaagatcggttgaggagtcaag

SEQ ID NO: 20346 - DNA, 60 bp, Artificial Sequence
  Description of Artificial Sequence: Synthetic probe
tgggatcaaccctatcaatgagacaacgccagacatcgcttcataaaacgctattggatg

SEQ ID NO: 20347 - DNA, 60 bp, Artificial Sequence
  Description of Artificial Sequence: Synthetic probe
gaaagaacaccaggcatgcgggttgtacattggacgcaggagctaactatggagtcgcag

SEQ ID NO: 20348 - DNA, 60 bp, Artificial Sequence
  Description of Artificial Sequence: Synthetic probe
cggggcacgttgattgcagcggaatgtgtcttaggtgacccgtataaaactttgcgacgg

SEQ ID NO: 20349 - DNA, 60 bp, Artificial Sequence
  Description of Artificial Sequence: Synthetic probe
tctccgagaatacagagaaaaccaatatcatgcaaaacacgagtggtcgcacagatgagg

SEQ ID NO: 20350 - DNA, 60 bp, Artificial Sequence
  Description of Artificial Sequence: Synthetic probe
gcttggactttcttaccgatgataaatggatggagtggatgctatctgacgctatggatg

SEQ ID NO: 20351 - DNA, 60 bp, Artificial Sequence
  Description of Artificial Sequence: Synthetic probe
cgacttactcagcgattacgattttatgattgatctgagtgataaagtagtgcacgccgg

SEQ ID NO: 20352 - DNA, 60 bp, Artificial Sequence
  Description of Artificial Sequence: Synthetic probe
acctaaattctcggtcggaactagtgttcccaaactactttgataaatggataaattctc

SEQ ID NO: 20353 - DNA, 60 bp, Artificial Sequence
  Description of Artificial Sequence: Synthetic probe
ttaactataaaccaacgaggaatgatggtatagtggtaccaaggctgttggatatcaccc

SEQ ID NO: 20354 - DNA, 60 bp, Artificial Sequence
  Description of Artificial Sequence: Synthetic probe
ccacaatggaggagttcgtcattcctgtgttttctgagagggagatcccttacgccctga

SEQ ID NO: 20355 - DNA, 60 bp, Artificial Sequence
  Description of Artificial Sequence: Synthetic probe
cccacaatggaggagtttgtcattcctgtgttttctgagagggagatcccttacgctctg

SEQ ID NO: 20356 - DNA, 60 bp, Artificial Sequence
  Description of Artificial Sequence: Synthetic probe
gcattgtcgtcaaacacagcgaagaaaatttattcaaccattgggaaagcagcggagcga

SEQ ID NO: 20357 - DNA, 60 bp, Artificial Sequence
  Description of Artificial Sequence: Synthetic probe
gaaagttggaaatgcattgtcgtcaaacacagcgaagaaaatttattcaaccattgggaa

SEQ ID NO: 20358 - DNA, 60 bp, Artificial Sequence
  Description of Artificial Sequence: Synthetic probe
tcccaaagttaaagagtgatttaggtggtttgaagaaaaagagggctatcatacacatga

SEQ ID NO: 20359 - DNA, 51 bp, Artificial Sequence
  Description of Artificial Sequence: Synthetic probe
gccttatatctatgtaccaatcaaagagggtcaaattgtgaatccaacatt

SEQ ID NO: 20360 - DNA, 51 bp, Artificial Sequence
  Description of Artificial Sequence: Synthetic probe
gccctatatctatgtaccaatcaaagagggtcaaattgtgaatccaacatt

SEQ ID NO: 20361 - DNA, 60 bp, Artificial Sequence
  Description of Artificial Sequence: Synthetic probe
gtgtggcctttaagataaatggaaccaagacagaagtgccttcatggtttaaaagcctta

SEQ ID NO: 20362 - DNA, 54 bp, Artificial Sequence
  Description of Artificial Sequence: Synthetic probe
agagagatattccatattcactgctgaatcattacccactagctatacagatag

SEQ ID NO: 20363 - DNA, 56 bp, Artificial Sequence
  Description of Artificial Sequence: Synthetic probe
gcatcgtgtagagtggttgatctcacgatgcagactcctactgctgtctaacgggg

SEQ ID NO: 20364 - DNA, 55 bp, Artificial Sequence
  Description of Artificial Sequence: Synthetic probe
catcgtgtagagtggttgatctcacgatgcagactcctactgctgtctaacgggg

SEQ ID NO: 20365 - DNA, 58 bp, Artificial Sequence
  Description of Artificial Sequence: Synthetic probe
ctgtatcgtgtagagtggttgatctcacgatgcagactcctactgctgtctaacgggg

SEQ ID NO: 20366 - DNA, 58 bp, Artificial Sequence
  Description of Artificial Sequence: Synthetic probe
ctgtatcgtgtagagtggttgatctcacgatgcagactcccactgctgtctaacgggg

SEQ ID NO: 20367 - DNA, 60 bp, Artificial Sequence
  Description of Artificial Sequence: Synthetic probe
gagtggcgccccaaggtctgtatcgtgtagagtggttgatctcacgatgcagactcctac

SEQ ID NO: 20368 - DNA, 60 bp, Artificial Sequence
  Description of Artificial Sequence: Synthetic probe
ggcgtttaagctaaatggtacatcaactgagatacctcaatggtttaagagtctgaaccc

SEQ ID NO: 20369 - DNA, 60 bp, Artificial Sequence
  Description of Artificial Sequence: Synthetic probe
agtgatatgagcgtggcgtttaagctaaatggtacatcaactgagatacctcaatggttt

SEQ ID NO: 20370 - DNA, 51 bp, Artificial Sequence
  Description of Artificial Sequence: Synthetic probe
cgctggatggtttcgaaatgccattaacctgaggacagtaggtagagtggc

SEQ ID NO: 20371 - DNA, 60 bp, Artificial Sequence
  Description of Artificial Sequence: Synthetic probe
cgtcaatcccgctggatggtttcgaaatgccattaacctgaggacagtaggtagagtggc

SEQ ID NO: 20372 - DNA, 52 bp, Artificial Sequence
  Description of Artificial Sequence: Synthetic probe
gaatggaggaagatgggtagttctaacagaagagattcgtcgcgcgatcgaa

SEQ ID NO: 20373 - DNA, 54 bp, Artificial Sequence
  Description of Artificial Sequence: Synthetic probe
gagtggaggaagatgggtagttctaacagaagagattgctcgcgcgatcgaatc

SEQ ID NO: 20374 - DNA, 54 bp, Artificial Sequence
  Description of Artificial Sequence: Synthetic probe
gaatggaggaagatgggtagttctaacagaagagatcgctcgcgcgatcgaatc

SEQ ID NO: 20375 - DNA, 60 bp, Artificial Sequence
  Description of Artificial Sequence: Synthetic probe
gaatggaggaagatgggtagttctaacagaagagattcgtcgcgcgatcgaatctaaata

SEQ ID NO: 20376 - DNA, 60 bp, Artificial Sequence
  Description of Artificial Sequence: Synthetic probe
tgtggtcaattttggagctaccttcctgatgatggtttgtgcaaaaagcgagagaacttt

SEQ ID NO: 20377 - DNA, 60 bp, Artificial Sequence
  Description of Artificial Sequence: Synthetic probe
cttaggaggcttaaagaagaaaagagctattatacatatgacactgctggtagcggcggt

SEQ ID NO: 20378 - DNA, 60 bp, Artificial Sequence
  Description of Artificial Sequence: Synthetic probe
tgacttaggaggcttaaagaagaaaagagctattatacatatgacactgctggtagcggc

SEQ ID NO: 20379 - DNA, 60 bp, Artificial Sequence
  Description of Artificial Sequence: Synthetic probe
cggaattttcatcagtcccgctagatggttttgaattgccattaacctaaggtcagtagg

SEQ ID NO: 20380 - DNA, 60 bp, Artificial Sequence
  Description of Artificial Sequence: Synthetic probe
tgatgcggtcaggatgagctttacagaattttcatcagtcccgctagatggtttcgaatt

SEQ ID NO: 20381 - DNA, 60 bp, Artificial Sequence
  Description of Artificial Sequence: Synthetic probe
tgacgcggtgaggatgagttttacagaattttcatcagtcccgctagatggtttcgaatt

SEQ ID NO: 20382 - DNA, 60 bp, Artificial Sequence
  Description of Artificial Sequence: Synthetic probe
tgatgcggtgaggatgagttttacagaattttcatcagtcccgctagatggtttcgaatt

SEQ ID NO: 20383 - DNA, 60 bp, Artificial Sequence
  Description of Artificial Sequence: Synthetic probe
cagatatttcagggtcgtaatgatcccatgatgatatatttggtatggagaagaatcgaa

SEQ ID NO: 20384 - DNA, 60 bp, Artificial Sequence
  Description of Artificial Sequence: Synthetic probe
gcggcgaatgaaatagcacgcgtgactggggagacttcgacatgggggccggcgcgtcag

SEQ ID NO: 20385 - DNA, 60 bp, Artificial Sequence
  Description of Artificial Sequence: Synthetic probe
gcggcgaatgaaatagcacgcgtgactggggaaacttcgacatgggggccggcgcgtcag

SEQ ID NO: 20386 - DNA, 60 bp, Artificial Sequence
  Description of Artificial Sequence: Synthetic probe
atgtgtcttgatatgatgttgtctgctgcgggaataaatgttggaccgatatcgccagat

SEQ ID NO: 20387 - DNA, 60 bp, Artificial Sequence
  Description of Artificial Sequence: Synthetic probe
ccgacctcgttggcgcaaagaaatgagatgttttttatgtgtcttgatatggtgttgtct

SEQ ID NO: 20388 - DNA, 60 bp, Artificial Sequence
  Description of Artificial Sequence: Synthetic probe
tgatgagttgcaaatgcatatactgaggggtccactacatttccaacggcgcgcaatact

SEQ ID NO: 20389 - DNA, 60 bp, Artificial Sequence
  Description of Artificial Sequence: Synthetic probe
cggcccattggcacgctctaggcgcagcgcaagaagctaaaggacgcactttgaatgagg

SEQ ID NO: 20390 - DNA, 60 bp, Artificial Sequence
  Description of Artificial Sequence: Synthetic probe
gtgcgccatgggattcagatgacgtcttcttcttccactgtatttcacatttccatgcca

SEQ ID NO: 20391 - DNA, 60 bp, Artificial Sequence
  Description of Artificial Sequence: Synthetic probe
tgacagcggacgtgttagaggcggcttcagaggaagtacctttggttggctcggggatgg

SEQ ID NO: 20392 - DNA, 60 bp, Artificial Sequence
  Description of Artificial Sequence: Synthetic probe
gcacacattagcgcgtgcgctacagagggaagcggctgaaaggactgaagctgaatcaac

SEQ ID NO: 20393 - DNA, 60 bp, Artificial Sequence
  Description of Artificial Sequence: Synthetic probe
agcaccattgggaaggcggcggagaggttcgcggagagtgaaattgggtccgcggcgatt

SEQ ID NO: 20394 - DNA, 60 bp, Artificial Sequence
  Description of Artificial Sequence: Synthetic probe
cgacgaactgatgacgaaattactcaacgtttaggtcctttgacacggacctgtggcctc

SEQ ID NO: 20395 - DNA, 60 bp, Artificial Sequence
  Description of Artificial Sequence: Synthetic probe
cccgctagacggtttcgaattaccattaacctaagatcagtaggtagagtggcgccccaa

SEQ ID NO: 20396 - DNA, 60 bp, Artificial Sequence
  Description of Artificial Sequence: Synthetic probe
attcgcatcgtacgcggaagcgtttcgtgatgatgtaagactgagacagatcaagcgcca

SEQ ID NO: 20397 - DNA, 60 bp, Artificial Sequence
  Description of Artificial Sequence: Synthetic probe
ctaagggatacgtgctgaatgttccaggatctggtgcgtacagaattcaggatgggcagg

SEQ ID NO: 20398 - DNA, 60 bp, Artificial Sequence
  Description of Artificial Sequence: Synthetic probe
aaaaatccggaacctaagggatacgtgctgaatgttccaggatctggtgcgtacagaatt

SEQ ID NO: 20399 - DNA, 60 bp, Artificial Sequence
  Description of Artificial Sequence: Synthetic probe
tgtcactgtgagcgtgggtggtgtggacatgagagcggggcgcataatcgcatgggatgg

SEQ ID NO: 20400 - DNA, 60 bp, Artificial Sequence
  Description of Artificial Sequence: Synthetic probe
ggtttatactacaccattttatccgcataagagttcgaacatgatactagcgtctttcct

SEQ ID NO: 20401 - DNA, 60 bp, Artificial Sequence
  Description of Artificial Sequence: Synthetic probe
gtgttctatgacaagtttcgaactgaaccaaaccgatacaaagctctatttcggtcatcg

SEQ ID NO: 20402 - DNA, 60 bp, Artificial Sequence
  Description of Artificial Sequence: Synthetic probe
cgatcaccaggacggtttagaagagtgttatggcacgtatatgacccaatagcgcctgag

SEQ ID NO: 20403 - DNA, 60 bp, Artificial Sequence
  Description of Artificial Sequence: Synthetic probe
acgatcaccaggacggtttagaagagtgttatggcacgtatatgacccaatagcgcctga

SEQ ID NO: 20404 - DNA, 60 bp, Artificial Sequence
  Description of Artificial Sequence: Synthetic probe
ctgcggcgaaaagagaagaatgggacgcatgctaaagctgttgagagaggaggacgcaag

SEQ ID NO: 20405 - DNA, 60 bp, Artificial Sequence
  Description of Artificial Sequence: Synthetic probe
tgagagatcttcggcgaaaagagaagaatgggacgcatgctaaagccattgagagagggg

SEQ ID NO: 20406 - DNA, 60 bp, Artificial Sequence
  Description of Artificial Sequence: Synthetic probe
gagagattgagagatcttcggcgaaaagagaagaatgggacgcatgctaaagccattgag

SEQ ID NO: 20407 - DNA, 60 bp, Artificial Sequence
  Description of Artificial Sequence: Synthetic probe
gatgaggttccagctcagatcatcgaggtggaacgcagtctccagaaagagctggggatt

SEQ ID NO: 20408 - DNA, 60 bp, Artificial Sequence
  Description of Artificial Sequence: Synthetic probe
gatgaggttccagctcagatcatcgaggtggaacgcagtctccagaaggagctggggatc

SEQ ID NO: 20409 - DNA, 60 bp, Artificial Sequence
  Description of Artificial Sequence: Synthetic probe
cgagagagatccagcatattaaagaggagattttaccaaagttcaagaaggtaatggatg

SEQ ID NO: 20410 - DNA, 60 bp, Artificial Sequence
  Description of Artificial Sequence: Synthetic probe
ggtattgcgattaacagatataatggattgacgcttcgtggagttacaatgcgcccgaca

SEQ ID NO: 20411 - DNA, 60 bp, Artificial Sequence
  Description of Artificial Sequence: Synthetic probe
cataccagtgttttctgagagagatattccatattcactgctaaatcattacccactagc

SEQ ID NO: 20412 - DNA, 60 bp, Artificial Sequence
  Description of Artificial Sequence: Synthetic probe
cataccagtgttttctgagagagatattccatattcactgctgaatcattacccactagc

SEQ ID NO: 20413 - DNA, 60 bp, Artificial Sequence
  Description of Artificial Sequence: Synthetic probe
aggaattcgtcataccagtgttttctgagagagatattccatattcactgctaaatcatt

SEQ ID NO: 20414 - DNA, 60 bp, Artificial Sequence
  Description of Artificial Sequence: Synthetic probe
gtgctagctctgcagttgcccgtaaatcctcaggtagtttgggatgttcctcggagctcg

SEQ ID NO: 20415 - DNA, 60 bp, Artificial Sequence
  Description of Artificial Sequence: Synthetic probe
tgatgaagatctacaaatgcacatactgagagggcccctacacttccagcggcgcgctat

SEQ ID NO: 20416 - DNA, 60 bp, Artificial Sequence
  Description of Artificial Sequence: Synthetic probe
taatgcacgcgcggcgtatgattagatcaaaaactgtgcaccccatttacttaggctcga

SEQ ID NO: 20417 - DNA, 60 bp, Artificial Sequence
  Description of Artificial Sequence: Synthetic probe
gggaattgacgttgttcatttcgaagatctcgctgcacattggcatgcgttaggcgcagc

SEQ ID NO: 20418 - DNA, 60 bp, Artificial Sequence
  Description of Artificial Sequence: Synthetic probe
tacatccaagggtaatgatgagatttaaggtgcctagatcacagcagccgcaaattcaca

SEQ ID NO: 20419 - DNA, 60 bp, Artificial Sequence
  Description of Artificial Sequence: Synthetic probe
gacaacgttagaacatagattcaaagatataccggacaaggagctagctgtgagcgtctt

SEQ ID NO: 20420 - DNA, 56 bp, Artificial Sequence
  Description of Artificial Sequence: Synthetic probe
ccaattcatgaacggcgaagttaagggtgaagaagagcaagaggagcaatataaag

SEQ ID NO: 20421 - DNA, 60 bp, Artificial Sequence
  Description of Artificial Sequence: Synthetic probe
aatgtactaggcgtaggagatgagatcccggacccgctcagtcctggagagcgtggcatc

SEQ ID NO: 20422 - DNA, 55 bp, Artificial Sequence
  Description of Artificial Sequence: Synthetic probe
aggcagcagagcgtcttgctgagagtgagatcggttcagccgcgattgatgggtt

SEQ ID NO: 20423 - DNA, 60 bp, Artificial Sequence
  Description of Artificial Sequence: Synthetic probe
gatgcgagcatgcgctacgcttcaagaggcaagaattgtgttggaagccaatgtgatgga

SEQ ID NO: 20424 - DNA, 60 bp, Artificial Sequence
  Description of Artificial Sequence: Synthetic probe
ggcgccccgaggtcgtatcgtgtagagtggttgatctcacgatgcagactcctactgctg

SEQ ID NO: 20425 - DNA, 60 bp, Artificial Sequence
  Description of Artificial Sequence: Synthetic probe
gctgaatcaacaatggttaaagagtacaggcagaaaattgatgcactaaaggccgccatc

SEQ ID NO: 20426 - DNA, 60 bp, Artificial Sequence
  Description of Artificial Sequence: Synthetic probe
gaagctgaatcaacaatggttaaagagtacaggcagaaaattgatgcactaaaggctgcc

SEQ ID NO: 20427 - DNA, 60 bp, Artificial Sequence
  Description of Artificial Sequence: Synthetic probe
aggactgaagctgaatcaacaatggttaaagagtacaggcagaaaattgatgcactaaag

SEQ ID NO: 20428 - DNA, 60 bp, Artificial Sequence
  Description of Artificial Sequence: Synthetic probe
gctgaaaggactgaagctgaatcaacaatggttaaagagtacaggcagaaaattgatgca

SEQ ID NO: 20429 - DNA, 60 bp, Artificial Sequence
  Description of Artificial Sequence: Synthetic probe
ggactagttcaaggtagcgttcactcaatcatgaccggggagtcatatggcgaatcggtg

SEQ ID NO: 20430 - DNA, 60 bp, Artificial Sequence
  Description of Artificial Sequence: Synthetic probe
cgcggcaattgatggactagttcaaggtagcgttcactcaatcatgaccggggagtcata

SEQ ID NO: 20431 - DNA, 60 bp, Artificial Sequence
  Description of Artificial Sequence: Synthetic probe
cattgggactagcgcaagaggcgagcgggcgtacgttaacggaggcgtatcgtgagtttc

SEQ ID NO: 20432 - DNA, 60 bp, Artificial Sequence
  Description of Artificial Sequence: Synthetic probe
gcattggggcaagcgcaagaggcgagcgggcgtacgttaacggaggcgtatcgtgaattt

SEQ ID NO: 20433 - DNA, 60 bp, Artificial Sequence
  Description of Artificial Sequence: Synthetic probe
cgcattgggattagcgcaagaggcgagcgggcgtacgttaacggaggcgtatcgtgagtt

SEQ ID NO: 20434 - DNA, 60 bp, Artificial Sequence
  Description of Artificial Sequence: Synthetic probe
cgcgttgggattagcgcaagaggcgagcgggcgtacgttaacggaggcgtatcgtgaatt

SEQ ID NO: 20435 - DNA, 60 bp, Artificial Sequence
  Description of Artificial Sequence: Synthetic probe
cacgcgttgggattagcgcaagaggtgagcgggcgtacgttaacggaggcgtatcgtgaa

SEQ ID NO: 20436 - DNA, 60 bp, Artificial Sequence
  Description of Artificial Sequence: Synthetic probe
cacgcattagggttagcgcaagaggcgagcgggcgtacgttaacggaggcgtatcgtgaa

SEQ ID NO: 20437 - DNA, 60 bp, Artificial Sequence
  Description of Artificial Sequence: Synthetic probe
cctgatgtttccaggacaaattatactcgatcttaagattgaccctggtgaaaggatgga

SEQ ID NO: 20438 - DNA, 60 bp, Artificial Sequence
  Description of Artificial Sequence: Synthetic probe
ttaaaatgcgtatgcgtgaagaagacatctcggcgttggaattcggtgatatgaagattg

SEQ ID NO: 20439 - DNA, 60 bp, Artificial Sequence
  Description of Artificial Sequence: Synthetic probe
gaattcaatattaaaatgcgtatgcgtgaagaagacatctcggcgttggaattcggtgat

SEQ ID NO: 20440 - DNA, 60 bp, Artificial Sequence
  Description of Artificial Sequence: Synthetic probe
tccaccatatttcaacaaatggacgcacgctccaatgtttaatgcgaaagtgaaaccatg

SEQ ID NO: 20441 - DNA, 60 bp, Artificial Sequence
  Description of Artificial Sequence: Synthetic probe
atgacgaaactattgaacgtttaggtcctatgacacggaccgatggcctcttacacttac

SEQ ID NO: 20442 - DNA, 60 bp, Artificial Sequence
  Description of Artificial Sequence: Synthetic probe
atgacgaaactattgaatgtctaggtcctatgacacggaccgatggcctcttacacttac

SEQ ID NO: 20443 - DNA, 60 bp, Artificial Sequence
  Description of Artificial Sequence: Synthetic probe
gcatacgcgttcagaacagatagttagtcggtataattactcacgtaagcacatttgtgg

SEQ ID NO: 20444 - DNA, 60 bp, Artificial Sequence
  Description of Artificial Sequence: Synthetic probe
ctgatgttccttgttcatgataacatctcgtattggcatagacagtggtcgattccaatg

SEQ ID NO: 20445 - DNA, 58 bp, Artificial Sequence
  Description of Artificial Sequence: Synthetic probe
ctgatgttccttgttcatgataacatctcgtattggcatagacagtggtcgattccaa

SEQ ID NO: 20446 - DNA, 51 bp, Artificial Sequence
  Description of Artificial Sequence: Synthetic probe
gagttaatcctgccggattatttcgacaaatggatcagttcaccaatgttt

SEQ ID NO: 20447 - DNA, 60 bp, Artificial Sequence
  Description of Artificial Sequence: Synthetic probe
ccgagttagttttgccggattatttcgacaaatggatcagttcaccaatgtttaacgcgc

SEQ ID NO: 20448 - DNA, 60 bp, Artificial Sequence
  Description of Artificial Sequence: Synthetic probe
atctgaatttacggtccgagttagttttgccggattatttcgacaaatggatcagttcac

SEQ ID NO: 20449 - DNA, 60 bp, Artificial Sequence
  Description of Artificial Sequence: Synthetic probe
tttgactagaggaacgcgaataggcaatagtggattggcctatgaacggttcatttcaag

SEQ ID NO: 20450 - DNA, 60 bp, Artificial Sequence
  Description of Artificial Sequence: Synthetic probe
gcggtgggacagccaaagtggatacacttgactagaggaacgcgaataggcaatagtgga

SEQ ID NO: 20451 - DNA, 59 bp, Artificial Sequence
  Description of Artificial Sequence: Synthetic probe
agcgctcgagggatagagttcatgacgaacgctagatggatgaaatgggccatagatga

SEQ ID NO: 20452 - DNA, 60 bp, Artificial Sequence
  Description of Artificial Sequence: Synthetic probe
aagtgctcgagggatagagttcatgacgaacgctagatggatgaaatgggccatagatga

SEQ ID NO: 20453 - DNA, 58 bp, Artificial Sequence
  Description of Artificial Sequence: Synthetic probe
aaaagcgctcgagggatagagttcatgacgaacgctagatggatgaagtgggccatag

SEQ ID NO: 20454 - DNA, 60 bp, Artificial Sequence
  Description of Artificial Sequence: Synthetic probe
atgatagaaaatcgacaaaaagcgctcgagggatagagttcatgacgaacgctagatgga

SEQ ID NO: 20455 - DNA, 50 bp, Artificial Sequence
  Description of Artificial Sequence: Synthetic probe
aaggaaaacataatgttgtaaagattcctgaatccgatatgatagatata

SEQ ID NO: 20456 - DNA, 60 bp, Artificial Sequence
  Description of Artificial Sequence: Synthetic probe
ccaccatggaggagttcgtcattccagtctattcagaagatgagattccatacgcgttac

SEQ ID NO: 20457 - DNA, 60 bp, Artificial Sequence
  Description of Artificial Sequence: Synthetic probe
ccaccatggaggagttcgtcattccagtctattcagaagatgagattccatatgcgttac

SEQ ID NO: 20458 - DNA, 60 bp, Artificial Sequence
  Description of Artificial Sequence: Synthetic probe
gagccaccatggaggagttcgtcattccagtctattcagaagatgacattccatatgcgt

SEQ ID NO: 20459 - DNA, 60 bp, Artificial Sequence
  Description of Artificial Sequence: Synthetic probe
gttaaaagagtgatccaccatggaggagttcgtcattccagtctattcagaagatgagat

SEQ ID NO: 20460 - DNA, 60 bp, Artificial Sequence
  Description of Artificial Sequence: Synthetic probe
ccttgaaatactggacaaagcgatgtcaaacacaactggtgcaacgcaaacacaaaaagc

SEQ ID NO: 20461 - DNA, 60 bp, Artificial Sequence
  Description of Artificial Sequence: Synthetic probe
gaaagaagtgatgaaaaaacaatcatataacgatgcggtaaggatgagttttacagagtt

SEQ ID NO: 20462 - DNA, 60 bp, Artificial Sequence
  Description of Artificial Sequence: Synthetic probe
tttctcaaccaccgaggtatgccccgagtgcgccgatgccgtcatctatgccaacggttg

SEQ ID NO: 20463 - DNA, 60 bp, Artificial Sequence
  Description of Artificial Sequence: Synthetic probe
agatggacactatcgcggcaagagcacttactgtaatgcgggcatgtgccactttacaag

SEQ ID NO: 20464 - DNA, 60 bp, Artificial Sequence
  Description of Artificial Sequence: Synthetic probe
agatggacactatctcggcaagagcacttactgtaatgcgggcatgtgccactttacaag

SEQ ID NO: 20465 - DNA, 60 bp, Artificial Sequence
  Description of Artificial Sequence: Synthetic probe
ggagttaaaacagaggcagattcagattaatatggttgattggacggagagtaagggcgg

SEQ ID NO: 20466 - DNA, 60 bp, Artificial Sequence
  Description of Artificial Sequence: Synthetic probe
gaagattcgaagatggctattttagcgcgtgcgttacaacgagaggcggcggaaagaagt

SEQ ID NO: 20467 - DNA, 60 bp, Artificial Sequence
  Description of Artificial Sequence: Synthetic probe
gaagattcgaagatggctattttagcgcgtgcgttacaacgagaggcagcggaaagaagt

SEQ ID NO: 20468 - DNA, 52 bp, Artificial Sequence
  Description of Artificial Sequence: Synthetic probe
tgagctgttaaaaaagaatatcttaaggcatcagttccgagttgctttatta

SEQ ID NO: 20469 - DNA, 60 bp, Artificial Sequence
  Description of Artificial Sequence: Synthetic probe
cgcgtacagacttagattataatccaacagataatgaaggtaatcaactaccacgagcgc

SEQ ID NO: 20470 - DNA, 60 bp, Artificial Sequence
  Description of Artificial Sequence: Synthetic probe
gcgcgtacagacttagattataatccaacagataatgaaggtaatcaactaccacgagcg

SEQ ID NO: 20471 - DNA, 60 bp, Artificial Sequence
  Description of Artificial Sequence: Synthetic probe
ggcttatgctacaatgtttgaaatggttcgatgcattatcactctatgctatgcagagaa

SEQ ID NO: 20472 - DNA, 60 bp, Artificial Sequence
  Description of Artificial Sequence: Synthetic probe
cgacaacggggccgttcgctattctgaccgggtcaaccccaactgcgcagcaacttaatg

SEQ ID NO: 20473 - DNA, 60 bp, Artificial Sequence
  Description of Artificial Sequence: Synthetic probe
cctgatatctctttgtgtaggttcatcggactgcgcgttgaatcatccgtgctgagggtc

SEQ ID NO: 20474 - DNA, 60 bp, Artificial Sequence
  Description of Artificial Sequence: Synthetic probe
cctgatcctcctgtgcctgatatctctttgtgtaggttcatcggactgcgcgttgaatca

SEQ ID NO: 20475 - DNA, 60 bp, Artificial Sequence
  Description of Artificial Sequence: Synthetic probe
gtcccgcttgatggtttcgagttaccattaacctaagatcagtaggtagagtggcgcccc

SEQ ID NO: 20476 - DNA, 60 bp, Artificial Sequence
  Description of Artificial Sequence: Synthetic probe
ggaagtcgatgccatatcgttgtattgcacgcagatggttatgctacgcgcggcgctcgg

SEQ ID NO: 20477 - DNA, 60 bp, Artificial Sequence
  Description of Artificial Sequence: Synthetic probe
ctcgcgagtgcggaattcttatgtagatcgaattgatgtgatattgagaaaggatgtcgt

SEQ ID NO: 20478 - DNA, 60 bp, Artificial Sequence
  Description of Artificial Sequence: Synthetic probe
cgatccgcaaataatgaatctagtcgaagagctcccacttggagagttttcacctggacg

SEQ ID NO: 20479 - DNA, 57 bp, Artificial Sequence
  Description of Artificial Sequence: Synthetic probe
aaagtttgattcgaacgatgaagacgggtttacgctgatacagattcgaaatccatt

SEQ ID NO: 20480 - DNA, 60 bp, Artificial Sequence
  Description of Artificial Sequence: Synthetic probe
cggtggcgaagtgtggacatgaagcctcacctagtaagacaatgatgacgccatattctg

SEQ ID NO: 20481 - DNA, 60 bp, Artificial Sequence
  Description of Artificial Sequence: Synthetic probe
catggctattgggaccttgatacaacgagaggttggaagggagcagccagggattctcac

SEQ ID NO: 20482 - DNA, 60 bp, Artificial Sequence
  Description of Artificial Sequence: Synthetic probe
cgttaaacctgaggatttatacacgtcgatgctgcgattagcgagaaatacaagttcagg

SEQ ID NO: 20483 - DNA, 60 bp, Artificial Sequence
  Description of Artificial Sequence: Synthetic probe
tccgatcgttgtcttacagtctacggcaggcgatgacaggaattcaaaggatgtgttcta

SEQ ID NO: 20484 - DNA, 60 bp, Artificial Sequence
  Description of Artificial Sequence: Synthetic probe
gatgcaagttatggctgattttgtaaaccgtttcgattcaccattccaccaggggaatag

SEQ ID NO: 20485 - DNA, 57 bp, Artificial Sequence
  Description of Artificial Sequence: Synthetic probe
gatgaaacatggaacaaaatatcgacggcaagcggaagagattatacgcaatatcag

SEQ ID NO: 20486 - DNA, 60 bp, Artificial Sequence
  Description of Artificial Sequence: Synthetic probe
accgtgagcgtgggtggtgtggacatgagagcgggacgtataatcgcgtgggatgggcag

SEQ ID NO: 20487 - DNA, 60 bp, Artificial Sequence
  Description of Artificial Sequence: Synthetic probe
gcctgagataccgttcacgactgaggccgcgaatgagattgcgcgtgttaccggagagac

SEQ ID NO: 20488 - DNA, 60 bp, Artificial Sequence
  Description of Artificial Sequence: Synthetic probe
acgcaacacatggccaccataggtgtgctggcgacgcctgagataccgttcacgactgag

SEQ ID NO: 20489 - DNA, 60 bp, Artificial Sequence
  Description of Artificial Sequence: Synthetic probe
atacgcaacacatggccaccataggtgtgctggcgacgcctgagataccgttcacgactg

SEQ ID NO: 20490 - DNA, 60 bp, Artificial Sequence
  Description of Artificial Sequence: Synthetic probe
cacctgactatacacaacacatggctaccataggtgtgctggcgacgcctgagataccgt

SEQ ID NO: 20491 - DNA, 60 bp, Artificial Sequence
  Description of Artificial Sequence: Synthetic probe
cgcctgactatacgcaacacatggctaccataggtgtgctggcgacgcctgagataccgt

SEQ ID NO: 20492 - DNA, 60 bp, Artificial Sequence
  Description of Artificial Sequence: Synthetic probe
gctggagcgcatcagaacgccgacccagtcgtactagatgtgagctggatatcgctgtgg

SEQ ID NO: 20493 - DNA, 60 bp, Artificial Sequence
  Description of Artificial Sequence: Synthetic probe
tgtttagagaagtagaggctggtgttagctggaacttggatcatcaaagtgaggaggagg

SEQ ID NO: 20494 - DNA, 60 bp, Artificial Sequence
  Description of Artificial Sequence: Synthetic probe
gggcagattggagaggttgcgtgaggcaagaactaatatgtttagagaagtagaggctgg

SEQ ID NO: 20495 - DNA, 60 bp, Artificial Sequence
  Description of Artificial Sequence: Synthetic probe
tgcttcgagcgtgggcagattggagaggttgcgtgaggcaagaactaatatgtttagaga

SEQ ID NO: 20496 - DNA, 53 bp, Artificial Sequence
  Description of Artificial Sequence: Synthetic probe
gcataatgttaacaccaagtggggtggaggcgacgactgagagatgggaagag

SEQ ID NO: 20497 - DNA, 54 bp, Artificial Sequence
  Description of Artificial Sequence: Synthetic probe
acattatgcggggtgatcgcgaaacagagttcacagccgtattgtcaaataaaa

SEQ ID NO: 20498 - DNA, 60 bp, Artificial Sequence
  Description of Artificial Sequence: Synthetic probe
agcaacgtaaatttactaaaaacatctttgttttagatgtcaatgctaaaacattatgcg

SEQ ID NO: 20499 - DNA, 60 bp, Artificial Sequence
  Description of Artificial Sequence: Synthetic probe
acgcgcggtgttttagaagcagcatcggaagaagtccccctgattggagcgggcatggct

SEQ ID NO: 20500 - DNA, 50 bp, Artificial Sequence
  Description of Artificial Sequence: Synthetic probe
gaaacagttatggtgaaggagtatcgtaataagattgatgcactaaagaa

SEQ ID NO: 20501 - DNA, 60 bp, Artificial Sequence
  Description of Artificial Sequence: Synthetic probe
cactgcagaaggaaattggcgagaggacgcatgcggaaacagttatggtgaaggagtatc

SEQ ID NO: 20502 - DNA, 60 bp, Artificial Sequence
  Description of Artificial Sequence: Synthetic probe
ggcgattagctaatgcactgcagaaggaaattggcgagaggacgcatgcggaaacagtta

SEQ ID NO: 20503 - DNA, 60 bp, Artificial Sequence
  Description of Artificial Sequence: Synthetic probe
catacacaccactctgttagtagctgctgtggttgcgctgttgacatcagtgtgcaccct

SEQ ID NO: 20504 - DNA, 60 bp, Artificial Sequence
  Description of Artificial Sequence: Synthetic probe
gacatcattttaaaaggaccggagctcagcgaagatgaggatgaaagagcttacgctaca

SEQ ID NO: 20505 - DNA, 60 bp, Artificial Sequence
  Description of Artificial Sequence: Synthetic probe
agatatcatcctgaaaggaccggagctcagcgaagatgaggatgaaagagcttatgctac

SEQ ID NO: 20506 - DNA, 60 bp, Artificial Sequence
  Description of Artificial Sequence: Synthetic probe
aggcagttttctagacatcattttaaaaggaccggagctcagcgaagatgaggatgaaag

SEQ ID NO: 20507 - DNA, 50 bp, Artificial Sequence
  Description of Artificial Sequence: Synthetic probe
cttctctcagccgtatgaggaggatatcgaaggcaagataaaacgatgcg

SEQ ID NO: 20508 - DNA, 60 bp, Artificial Sequence
  Description of Artificial Sequence: Synthetic probe
taaaagcttctctcagccgtatgaggaggatatcgaaggcaagataaaacgatgcggtgc

SEQ ID NO: 20509 - DNA, 60 bp, Artificial Sequence
  Description of Artificial Sequence: Synthetic probe
ttggctgcagtgttttaaaagcttctctcagccgtatgaggaggatatcgaaggcaagat

SEQ ID NO: 20510 - DNA, 60 bp, Artificial Sequence
  Description of Artificial Sequence: Synthetic probe
gatcgagaaactgtttggctacaatgctttaaaagcttctctcagccgtatgaggaggat

SEQ ID NO: 20511 - DNA, 60 bp, Artificial Sequence
  Description of Artificial Sequence: Synthetic probe
ctgagagggcccctacacttccagcggcgcgctatattgggtgcgttgaagtttggcgta

SEQ ID NO: 20512 - DNA, 60 bp, Artificial Sequence
  Description of Artificial Sequence: Synthetic probe
ggctcattggcatgcattgggagcggctcagatggctgtaggacgtacgttaaccgaagc

SEQ ID NO: 20513 - DNA, 60 bp, Artificial Sequence
  Description of Artificial Sequence: Synthetic probe
cggcatgcaggaagaggcgatacaagaaatagcggggatgactgctgatgtgttagaggc

SEQ ID NO: 20514 - DNA, 60 bp, Artificial Sequence
  Description of Artificial Sequence: Synthetic probe
gagctggagcaggtgtatgagtttatgaacggtgcggcgaaggaagaagtcggagctgag

SEQ ID NO: 20515 - DNA, 60 bp, Artificial Sequence
  Description of Artificial Sequence: Synthetic probe
ggttcagcggcgattgatggcttagtgcagggtagcgtacattcaatattgacaggcgag

SEQ ID NO: 20516 - DNA, 60 bp, Artificial Sequence
  Description of Artificial Sequence: Synthetic probe
aaattagggactaaccactcagtgggagatctggttacggttttcacgcttatgaatatc

SEQ ID NO: 20517 - DNA, 60 bp, Artificial Sequence
  Description of Artificial Sequence: Synthetic probe
gattagatgagagcgagcgagacaaaggtggtttcaaggtccccaagggagtgcttccag

SEQ ID NO: 20518 - DNA, 60 bp, Artificial Sequence
  Description of Artificial Sequence: Synthetic probe
agatcggagggaaggtgattgtcggagatttagaggctacggggtcgcgcgtgatggacg

SEQ ID NO: 20519 - DNA, 60 bp, Artificial Sequence
  Description of Artificial Sequence: Synthetic probe
tatgaagattgatccagttggactattgcgtgagttctttattctgtgcttaccacaccc

SEQ ID NO: 20520 - DNA, 60 bp, Artificial Sequence
  Description of Artificial Sequence: Synthetic probe
tcagtctgcacgttatcgagtgatatgagcgtggcatttaagctaaatggtacatcagct

SEQ ID NO: 20521 - DNA, 60 bp, Artificial Sequence
  Description of Artificial Sequence: Synthetic probe
tgatgatgtgagactcaaacagattaaacgtcatgtcaatgaacagatactcccaaagtt

SEQ ID NO: 20522 - DNA, 60 bp, Artificial Sequence
  Description of Artificial Sequence: Synthetic probe
tgatgatgtgagactcagacagattaaacgtcatgtcaatgaacagatactcccaaagtt

SEQ ID NO: 20523 - DNA, 60 bp, Artificial Sequence
  Description of Artificial Sequence: Synthetic probe
tcgcgaagcattttaacaggtatgcttcgatggcgatacagcaatatttgagagttggtt

SEQ ID NO: 20524 - DNA, 60 bp, Artificial Sequence
  Description of Artificial Sequence: Synthetic probe
ttgcgaaacattttaacaggtatgcttcgatggcgatacagcaatatttgagagttggtt

SEQ ID NO: 20525 - DNA, 60 bp, Artificial Sequence
  Description of Artificial Sequence: Synthetic probe
taaggatggatgattttgcgaaacattttaacaggtatgcttcgatggcgatacagcaat

SEQ ID NO: 20526 - DNA, 60 bp, Artificial Sequence
  Description of Artificial Sequence: Synthetic probe
cttaaggatggatgattttgcgaagcattttaacaggtatgcttcgatggcgatacagcg

SEQ ID NO: 20527 - DNA, 60 bp, Artificial Sequence
  Description of Artificial Sequence: Synthetic probe
cgcgtgggatgggcaggcggtgctacaaattcacaatccaacccagcaaaacgctatggt

SEQ ID NO: 20528 - DNA, 60 bp, Artificial Sequence
  Description of Artificial Sequence: Synthetic probe
aatcgcgtgggatgggcaggcggtgctacaaattcacaatccaacccagcaaaacgctat

SEQ ID NO: 20529 - DNA, 60 bp, Artificial Sequence
  Description of Artificial Sequence: Synthetic probe
gcctgagccacacgcagtactctatgtcacaaacgagctctctcacatcgttaagaatgg

SEQ ID NO: 20530 - DNA, 60 bp, Artificial Sequence
  Description of Artificial Sequence: Synthetic probe
atgcctgagccacacgcagtactctatgtcacaaacgagctctctcacatcgttaagagt

SEQ ID NO: 20531 - DNA, 60 bp, Artificial Sequence
  Description of Artificial Sequence: Synthetic probe
gcgtcggaggtgttgacatgagggcaggacgtataattgcgtgggatggacaggccgcat

SEQ ID NO: 20532 - DNA, 60 bp, Artificial Sequence
  Description of Artificial Sequence: Synthetic probe
ggagagagtcgaagagctaagtctggttcgtgtggatgatacaatttcacaaccgccgag

SEQ ID NO: 20533 - DNA, 60 bp, Artificial Sequence
  Description of Artificial Sequence: Synthetic probe
cagattgacatgatcaagaaggaagttatgaagaaacagtcatataatgatgcggtgagg

SEQ ID NO: 20534 - DNA, 60 bp, Artificial Sequence
  Description of Artificial Sequence: Synthetic probe
gggctaaaccagcagattgacatgatcaagaaggaagttatgaagaaacagtcatataat

SEQ ID NO: 20535 - DNA, 60 bp, Artificial Sequence
  Description of Artificial Sequence: Synthetic probe
aggaaaaaatgaaacataatcaggagagagtcgaagagctaagtctggttcgtgtggatg

SEQ ID NO: 20536 - DNA, 60 bp, Artificial Sequence
  Description of Artificial Sequence: Synthetic probe
aggaaaaaatgaaacataatcaggagagagtcgaagagctaagtctggttcgtgcggatg

SEQ ID NO: 20537 - DNA, 60 bp, Artificial Sequence
  Description of Artificial Sequence: Synthetic probe
ccatggcatgtgagaaatgatctgattgctgcgctaagggaatacaaacggaaaaagggg

SEQ ID NO: 20538 - DNA, 55 bp, Artificial Sequence
  Description of Artificial Sequence: Synthetic probe
ccatggcatgtgagaaatgatctgattgctgcgctaagggaatacaaacggaaaa

SEQ ID NO: 20539 - DNA, 60 bp, Artificial Sequence
  Description of Artificial Sequence: Synthetic probe
ggatgggcaggatatcattagcctgatgttgacaccgcatggagttgaagcgacaacgga

SEQ ID NO: 20540 - DNA, 60 bp, Artificial Sequence
  Description of Artificial Sequence: Synthetic probe
ataggagcggggatggcgacagcagttgcgactgggagagctatcgagggagcatacaag

SEQ ID NO: 20541 - DNA, 60 bp, Artificial Sequence
  Description of Artificial Sequence: Synthetic probe
gacgcaatagagatgacttttcctcggtttggacgtatgctaagaaatgcgtctcaggca

SEQ ID NO: 20542 - DNA, 60 bp, Artificial Sequence
  Description of Artificial Sequence: Synthetic probe
gcagggattgtttcaaggcgtctggaatacaaggaacgagagaacagatgcttgacggag

SEQ ID NO: 20543 - DNA, 60 bp, Artificial Sequence
  Description of Artificial Sequence: Synthetic probe
ttacgcattaccgaggttgtgattggaacggctcacaccgacgatccagctgtagggcgc

SEQ ID NO: 20544 - DNA, 60 bp, Artificial Sequence
  Description of Artificial Sequence: Synthetic probe
tgtgttaacgattgattttgagaaggacgcgcacatcggcacgggttcggccctgagttt

SEQ ID NO: 20545 - DNA, 60 bp, Artificial Sequence
  Description of Artificial Sequence: Synthetic probe
ccgataccaataaaggtcgtatatggtggagcaatccgtatccctgcctgcgtggagcgt

SEQ ID NO: 20546 - DNA, 60 bp, Artificial Sequence
  Description of Artificial Sequence: Synthetic probe
tggtacaagttcgaattgaagggaagacgcctttggtaatacaagaggaaataaccgctt

SEQ ID NO: 20547 - DNA, 60 bp, Artificial Sequence
  Description of Artificial Sequence: Synthetic probe
aggtagatatcgctcacacgcgctcgaggatcagccacgcactctttaactgtacggtgc

SEQ ID NO: 20548 - DNA, 60 bp, Artificial Sequence
  Description of Artificial Sequence: Synthetic probe
gcgtcgcgatggaggagctagcgattccgatttatacgaatgtattcccagcggagcttt

SEQ ID NO: 20549 - DNA, 60 bp, Artificial Sequence
  Description of Artificial Sequence: Synthetic probe
tgttagtgttctatcaaaaaatcgcgcgattcaagaaaaccacaaagaactgatgcatat

SEQ ID NO: 20550 - DNA, 60 bp, Artificial Sequence
  Description of Artificial Sequence: Synthetic probe
ggggacgcaagcagaggaagaaaacccatggtgacgcgcagagagaaggtgtcgaggaag

SEQ ID NO: 20551 - DNA, 60 bp, Artificial Sequence
  Description of Artificial Sequence: Synthetic probe
ttagcgttggtggagtcgacatgagggcgggacgcattatagcatgggatggacaggccg

SEQ ID NO: 20552 - DNA, 60 bp, Artificial Sequence
  Description of Artificial Sequence: Synthetic probe
gcgtaactgttagcgttggtggagtcgacatgagggcgggacgcattatagcatgggatg

SEQ ID NO: 20553 - DNA, 60 bp, Artificial Sequence
  Description of Artificial Sequence: Synthetic probe
gttgacgtccgtattcctcgggaggttgcaaggagccatgatatgaaagcttttgaaaat

SEQ ID NO: 20554 - DNA, 60 bp, Artificial Sequence
  Description of Artificial Sequence: Synthetic probe
aacgggaacaggatataatggttgggcgacgattgatgtcgagtatagagaacccgcacc

SEQ ID NO: 20555 - DNA, 60 bp, Artificial Sequence
  Description of Artificial Sequence: Synthetic probe
ccgagcagattttgcaacgggaacaggatataatggttgggcgacgattgatgtcgagta

SEQ ID NO: 20556 - DNA, 60 bp, Artificial Sequence
  Description of Artificial Sequence: Synthetic probe
gcattatgcggcggtttatcggactcgctcgtttataccctcccaataacacatccagag

SEQ ID NO: 20557 - DNA, 60 bp, Artificial Sequence
  Description of Artificial Sequence: Synthetic probe
gagcggcgcgaccaattgcgtgaggttggagaggcgcgaatgatcatatatcaaatccag

SEQ ID NO: 20558 - DNA, 60 bp, Artificial Sequence
  Description of Artificial Sequence: Synthetic probe
ggagtgattgaaagtgaaaagaaaagcgacccgtggaataaacgtgtagcgaacggcacg

SEQ ID NO: 20559 - DNA, 60 bp, Artificial Sequence
  Description of Artificial Sequence: Synthetic probe
gcacgtatgcgcgatgaagcgataacgggtggatggcgacaggaagacttcaagttacat

SEQ ID NO: 20560 - DNA, 60 bp, Artificial Sequence
  Description of Artificial Sequence: Synthetic probe
gaacctttacccttgtttgcgaggtgcgttggttgcagcagagtgtgtgatgggtgatgt

SEQ ID NO: 20561 - DNA, 60 bp, Artificial Sequence
  Description of Artificial Sequence: Synthetic probe
ggtatttcacgacgctttcaaattgagttagatggcatgtttagtgcggcgcgtcaggag

SEQ ID NO: 20562 - DNA, 60 bp, Artificial Sequence
  Description of Artificial Sequence: Synthetic probe
attgcgggtgagatgggacgacttgcgaaaatcaaagacaagtgggtgtcaaacgggttt

SEQ ID NO: 20563 - DNA, 60 bp, Artificial Sequence
  Description of Artificial Sequence: Synthetic probe
tcgatacggtgtactacgattatcatccgcttgagagtgaggcgactaagtgtaatcatg

SEQ ID NO: 20564 - DNA, 57 bp, Artificial Sequence
  Description of Artificial Sequence: Synthetic probe
cccgacgtatgattcgatcgaaagcggtgcatccaatctatttaggatcgatgcatt

SEQ ID NO: 20565 - DNA, 60 bp, Artificial Sequence
  Description of Artificial Sequence: Synthetic probe
agcaatcggtagtacctacacttctccaatgcacgcccgacgtatgattcgatcgaaagc

SEQ ID NO: 20566 - DNA, 53 bp, Artificial Sequence
  Description of Artificial Sequence: Synthetic probe
gggaatcatatggcgaatcggtgaaacaagctgtactgctgaacgttctgggg

SEQ ID NO: 20567 - DNA, 53 bp, Artificial Sequence
  Description of Artificial Sequence: Synthetic probe
gggaatcatatggccaatcggtgaaacaagctgtactgctgaacgttctgggg

SEQ ID NO: 20568 - DNA, 59 bp, Artificial Sequence
  Description of Artificial Sequence: Synthetic probe
gggaatcatatggccaatcggtgaaacaagctgtactgctgaacgttctgggggcgggg

SEQ ID NO: 20569 - DNA, 59 bp, Artificial Sequence
  Description of Artificial Sequence: Synthetic probe
gggaatcatatggcgaatcggtgaaacaagctgtactgctgaacgttctgggggcgggg

SEQ ID NO: 20570 - DNA, 60 bp, Artificial Sequence
  Description of Artificial Sequence: Synthetic probe
gcaccataggaaaggcggcggaaaggttcgcggaaagtgagattgggtccgcagcaattg

SEQ ID NO: 20571 - DNA, 60 bp, Artificial Sequence
  Description of Artificial Sequence: Synthetic probe
agcaccataggaaaggcggcggaaaggttcgcggaaagtgagattgggtccgcagcaatt

SEQ ID NO: 20572 - DNA, 60 bp, Artificial Sequence
  Description of Artificial Sequence: Synthetic probe
aagcatatgttgaagcaaaagagcgtagagaagagatcgttaaacccgaggatttataca

SEQ ID NO: 20573 - DNA, 60 bp, Artificial Sequence
  Description of Artificial Sequence: Synthetic probe
aagcatatgttgaagcaaaagaacgtagagaagagatcgttaaacccgaggatttataca

SEQ ID NO: 20574 - DNA, 60 bp, Artificial Sequence
  Description of Artificial Sequence: Synthetic probe
tttgttgttgtcgactttggccgatgtctatactgtactgcgaccggagttcgatataca

SEQ ID NO: 20575 - DNA, 60 bp, Artificial Sequence
  Description of Artificial Sequence: Synthetic probe
tggcgacgattggagtgctagcaacgccggagatccctttcacaacggaggctgcgaacg

SEQ ID NO: 20576 - DNA, 60 bp, Artificial Sequence
  Description of Artificial Sequence: Synthetic probe
gtaggtagagtggcgccccgaggtctgtgtcgtgtagagtggtgatctcacgatgcgact

SEQ ID NO: 20577 - DNA, 60 bp, Artificial Sequence
  Description of Artificial Sequence: Synthetic probe
gaagcgagaattgtgttagaagccaatgtgatggaaattttgggtattgcgattaacagg

SEQ ID NO: 20578 - DNA, 60 bp, Artificial Sequence
  Description of Artificial Sequence: Synthetic probe
aagctgtaattaattggaatctggatgagagagatgaagaggatagagatgaacgggggg

SEQ ID NO: 20579 - DNA, 60 bp, Artificial Sequence
  Description of Artificial Sequence: Synthetic probe
gacgttgttggccgccgctgtcgtagcgttgttgacgtcggtatgcacactttcgagtga

SEQ ID NO: 20580 - DNA, 60 bp, Artificial Sequence
  Description of Artificial Sequence: Synthetic probe
tacacatgacgttgttggccgccgctgtcgtagcgttgttgacgtcggtatgcacacttt

SEQ ID NO: 20581 - DNA, 60 bp, Artificial Sequence
  Description of Artificial Sequence: Synthetic probe
ccgatgttgggtgtggtgaatgtgggggctacctttctgatgatggtttgcgcaaaaagt

SEQ ID NO: 20582 - DNA, 60 bp, Artificial Sequence
  Description of Artificial Sequence: Synthetic probe
ggaacgggttgaagaactgagtttagttcgtgtggatgacgcgatttctcaaccaccaag

SEQ ID NO: 20583 - DNA, 60 bp, Artificial Sequence
  Description of Artificial Sequence: Synthetic probe
taatcaggaacgggttgaagaactgagtttagttcgtgtggatgacgcgatttctcaacc

SEQ ID NO: 20584 - DNA, 54 bp, Artificial Sequence
  Description of Artificial Sequence: Synthetic probe
tcccgctcttcctaaaaaacgcgtgactgcggtaatctcgggactttcacttac

SEQ ID NO: 20585 - DNA, 54 bp, Artificial Sequence
  Description of Artificial Sequence: Synthetic probe
tcccgctcttcctaaaaaacgcgtgactgcggtaatctcgggacttacacttac

SEQ ID NO: 20586 - DNA, 60 bp, Artificial Sequence
  Description of Artificial Sequence: Synthetic probe
ggaatagttcaaggtagcgttcactcaatcatgaccggagagtcgtacggcgaatcggtg

SEQ ID NO: 20587 - DNA, 60 bp, Artificial Sequence
  Description of Artificial Sequence: Synthetic probe
cgcggcgattgatggaatagttcaaggtagcgttcactcaatcatgaccggagagtcgta

SEQ ID NO: 20588 - DNA, 60 bp, Artificial Sequence
  Description of Artificial Sequence: Synthetic probe
agcacgtcagccctatggttttttccttgaaactgaagagactttccaacctgggagatg

SEQ ID NO: 20589 - DNA, 60 bp, Artificial Sequence
  Description of Artificial Sequence: Synthetic probe
gaggatcatggacatcacccaatcgctcaagatgggcaccaagctggctgcgccaactgt

SEQ ID NO: 20590 - DNA, 60 bp, Artificial Sequence
  Description of Artificial Sequence: Synthetic probe
aatgaggatcatggacatcacccaatcgctcaagatgggcaccaagctggctgcgccaac

SEQ ID NO: 20591 - DNA, 60 bp, Artificial Sequence
  Description of Artificial Sequence: Synthetic probe
attgagtaagtattattattcacgcagacatatatgcggagttgtagctgtaagtgtggg

SEQ ID NO: 20592 - DNA, 60 bp, Artificial Sequence
  Description of Artificial Sequence: Synthetic probe
cgtttacacgttgccggtcgcgcatccgaagaaatgtatcgttctaatcgtcgtaggaga

SEQ ID NO: 20593 - DNA, 60 bp, Artificial Sequence
  Description of Artificial Sequence: Synthetic probe
cgatcgtttacacgttgccggtcgcgcatccgaagaaatgtatcgttctaatcgtcgtag

SEQ ID NO: 20594 - DNA, 60 bp, Artificial Sequence
  Description of Artificial Sequence: Synthetic probe
gcgcggtacgtggatacattaagccccttgcggaatcgttagattttgttctcgggccct

SEQ ID NO: 20595 - DNA, 60 bp, Artificial Sequence
  Description of Artificial Sequence: Synthetic probe
aatctaaatacggtacgaaagttgatgtttacagagatgaggtcccagtacagatcatcg

SEQ ID NO: 20596 - DNA, 60 bp, Artificial Sequence
  Description of Artificial Sequence: Synthetic probe
aatctaaatacggtacgaaagttgatgtttacagagatgaggttccagcacagatcatcg

SEQ ID NO: 20597 - DNA, 60 bp, Artificial Sequence
  Description of Artificial Sequence: Synthetic probe
aatctaaatacggtacgaaagttgatgtttacagagatgaggcgtcagcgcagataatcg

SEQ ID NO: 20598 - DNA, 60 bp, Artificial Sequence
  Description of Artificial Sequence: Synthetic probe
gagggaactttgaaccagcaaattgacatgattaagaaggaagtgatgaaaaaacaatcg

SEQ ID NO: 20599 - DNA, 60 bp, Artificial Sequence
  Description of Artificial Sequence: Synthetic probe
gctcgaggattaccgcaaaagtgggatgatggatgaggccgtgaagcagtctgcattggt

SEQ ID NO: 20600 - DNA, 60 bp, Artificial Sequence
  Description of Artificial Sequence: Synthetic probe
gaggtgtggatatgagggcgggacggataatcgcgtgggatggacaagcggttctgcaga

SEQ ID NO: 20601 - DNA, 60 bp, Artificial Sequence
  Description of Artificial Sequence: Synthetic probe
gttaaaaagtgtcgctgccatgctatccgagctgatccaaaggttcgaagaagaaaagat

SEQ ID NO: 20602 - DNA, 60 bp, Artificial Sequence
  Description of Artificial Sequence: Synthetic probe
gccgatcaaagaaggtcaaattgtgaatccaacatttatatcaagatatcgccaaattgc

SEQ ID NO: 20603 - DNA, 60 bp, Artificial Sequence
  Description of Artificial Sequence: Synthetic probe
gatgggttgttatggtatgttcctataacgcacccgtcaaaatgtttagttgcctttgaa

SEQ ID NO: 20604 - DNA, 60 bp, Artificial Sequence
  Description of Artificial Sequence: Synthetic probe
gggtattcagatgggttgttatggtatgttcctataacgcacccgtcaaaatgtttagtt

SEQ ID NO: 20605 - DNA, 60 bp, Artificial Sequence
  Description of Artificial Sequence: Synthetic probe
gcgtctttatgtggtgggtattcggatgggttgttatggtatgttcctataacgcacccg

SEQ ID NO: 20606 - DNA, 60 bp, Artificial Sequence
  Description of Artificial Sequence: Synthetic probe
gcatattgacccttttgttgctgtcaactctggctgatgtctatactgtactgcgaccgg

SEQ ID NO: 20607 - DNA, 60 bp, Artificial Sequence
  Description of Artificial Sequence: Synthetic probe
caaacgatcgagatagcatattgacccttttgttgctgtcaactctggctgatgtctata

SEQ ID NO: 20608 - DNA, 60 bp, Artificial Sequence
  Description of Artificial Sequence: Synthetic probe
tactctgccaaatatgctgccacctatatttcctccaaacgatcgagatagcatattgac

SEQ ID NO: 20609 - DNA, 60 bp, Artificial Sequence
  Description of Artificial Sequence: Synthetic probe
tatattaaatagaactactctgccaaatatgctgccacctatatttcctccaaacgatcg

SEQ ID NO: 20610 - DNA, 60 bp, Artificial Sequence
  Description of Artificial Sequence: Synthetic probe
gggggccggcgcgccagccatacggcttttttctagaaacagaagagacgtatcagcccg

SEQ ID NO: 20611 - DNA, 60 bp, Artificial Sequence
  Description of Artificial Sequence: Synthetic probe
caggtataatggattaacgctccgtggagtcacaatgcgcccgacatctttagctcaaag

SEQ ID NO: 20612 - DNA, 60 bp, Artificial Sequence
  Description of Artificial Sequence: Synthetic probe
cgcgacttcaggccaatatgggacagtttcgcgcggcgttacgacgtatcatggatgacg

SEQ ID NO: 20613 - DNA, 60 bp, Artificial Sequence
  Description of Artificial Sequence: Synthetic probe
gtcgagttctcaaatacacctgactccctggtgttgataaacccgacatatacgatgact

SEQ ID NO: 20614 - DNA, 60 bp, Artificial Sequence
  Description of Artificial Sequence: Synthetic probe
ttgggtacttcttccgtcgctgcagccatcgttaaagctcgtattggaagaggaggcatg

SEQ ID NO: 20615 - DNA, 60 bp, Artificial Sequence
  Description of Artificial Sequence: Synthetic probe
ccacgcagttctatcgccaacttaatcatgaatatagcgacatgcttgcctacaggagag

SEQ ID NO: 20616 - DNA, 60 bp, Artificial Sequence
  Description of Artificial Sequence: Synthetic probe
gggatgtgccacgcagttctatcgccaacttaatcatgaatatagcgacatgcttgccta

SEQ ID NO: 20617 - DNA, 60 bp, Artificial Sequence
  Description of Artificial Sequence: Synthetic probe
gcttagtacgtgtggatgataccatttctcaaccaccgaggtatgccccgagtgcgccga

SEQ ID NO: 20618 - DNA, 60 bp, Artificial Sequence
  Description of Artificial Sequence: Synthetic probe
gctgaagagatcaggtatgtgcaacagctttttggaagggttccaacgggtgaattccca

SEQ ID NO: 20619 - DNA, 60 bp, Artificial Sequence
  Description of Artificial Sequence: Synthetic probe
ggtcaaatccgtatccatgcttgcgcggcacgttgattgcggcggagacaaaattaggcg

SEQ ID NO: 20620 - DNA, 60 bp, Artificial Sequence
  Description of Artificial Sequence: Synthetic probe
gaggatttggtggtcaaatccgtacccatgcttgcgcggcacgttgattgcggcggagac

SEQ ID NO: 20621 - DNA, 60 bp, Artificial Sequence
  Description of Artificial Sequence: Synthetic probe
aggctcaatgcattacgatataacctatgaagctctgaagaacaacgcgcagcggatagt

SEQ ID NO: 20622 - DNA, 60 bp, Artificial Sequence
  Description of Artificial Sequence: Synthetic probe
gccactggcacgcgttaggaatggcacaagaagctagtggacggactttaacggaggcct

SEQ ID NO: 20623 - DNA, 60 bp, Artificial Sequence
  Description of Artificial Sequence: Synthetic probe
ggctttgatctgggaattgatgtagttcactttgaggacttgaccagccactggcacgcg

SEQ ID NO: 20624 - DNA, 60 bp, Artificial Sequence
  Description of Artificial Sequence: Synthetic probe
agagggcatagaggataaagttatacacccgagagtaatgatgaggtttaagatcccacg

SEQ ID NO: 20625 - DNA, 60 bp, Artificial Sequence
  Description of Artificial Sequence: Synthetic probe
aataagaagacggctgtagctgataattgcagcgagatcgctcatattaagcaagagata

SEQ ID NO: 20626 - DNA, 60 bp, Artificial Sequence
  Description of Artificial Sequence: Synthetic probe
agcctaccattatcgccacaactctcgaacataggtttaaagatatacctgatgaacagc

SEQ ID NO: 20627 - DNA, 60 bp, Artificial Sequence
  Description of Artificial Sequence: Synthetic probe
cagcggaattgatctttcacatatgcgaagccctaagattgagcctaccattatcgccac

SEQ ID NO: 20628 - DNA, 60 bp, Artificial Sequence
  Description of Artificial Sequence: Synthetic probe
ggacgtgttagaagcagcatcagaagaagtgccattgataggtgctggcatggcaacggc

SEQ ID NO: 20629 - DNA, 60 bp, Artificial Sequence
  Description of Artificial Sequence: Synthetic probe
ggactcaaagatggctattttggcacgagcgttacagcgagaagcagcagaaagaagtga

SEQ ID NO: 20630 - DNA, 60 bp, Artificial Sequence
  Description of Artificial Sequence: Synthetic probe
ctagaagatgagcaacgtaacgaacttgtgaggcttaaatataataaagagattaccgag

SEQ ID NO: 20631 - DNA, 60 bp, Artificial Sequence
  Description of Artificial Sequence: Synthetic probe
atatggggaatcggtgaaacaggcggtcctactgaatgtattgggtacgggcgaagagct

SEQ ID NO: 20632 - DNA, 60 bp, Artificial Sequence
  Description of Artificial Sequence: Synthetic probe
attgatggattagtgcagggaagcgttcactcgataataacgggggaatcatatggggaa

SEQ ID NO: 20633 - DNA, 60 bp, Artificial Sequence
  Description of Artificial Sequence: Synthetic probe
ggcggagcgttttgcggagagtgagataggtgcggcgacgattgatggattagtgcaggg

SEQ ID NO: 20634 - DNA, 60 bp, Artificial Sequence
  Description of Artificial Sequence: Synthetic probe
taaggaccgctatactaaacagaacaacccttccaaacatgttacccccaatctttccgc

SEQ ID NO: 20635 - DNA, 60 bp, Artificial Sequence
  Description of Artificial Sequence: Synthetic probe
ttgctatacatggtgtaaatccaatgccgggtccgctcacgcgagcaatcgcgcgcgccg

SEQ ID NO: 20636 - DNA, 56 bp, Artificial Sequence
  Description of Artificial Sequence: Synthetic probe
taaatagaactactctgccaaatatgttgccaccaatatttcctccaaacgatcga

SEQ ID NO: 20637 - DNA, 60 bp, Artificial Sequence
  Description of Artificial Sequence: Synthetic probe
ttagtgtcggaggtgttgacatgagggcggggcgtataattgcgtgggatggacaggccg

SEQ ID NO: 20638 - DNA, 60 bp, Artificial Sequence
  Description of Artificial Sequence: Synthetic probe
gatcgagaattttgcgatggcgcaggggaattcacaacaaacgctggctggtgtaacggt

SEQ ID NO: 20639 - DNA, 60 bp, Artificial Sequence
  Description of Artificial Sequence: Synthetic probe
ggtgtgtggcccagatatgatccaagtgtcgttgaatgccggtgctagaggtgatgtaca

SEQ ID NO: 20640 - DNA, 51 bp, Artificial Sequence
  Description of Artificial Sequence: Synthetic probe
ttaaacgccatgtaaatgaacagattttacccaaactgaaaagtgatttaa

SEQ ID NO: 20641 - DNA, 60 bp, Artificial Sequence
  Description of Artificial Sequence: Synthetic probe
aggccgtaactgccggggtgtgtggcccagatatgatccaagtgtcattgaatgctggtg

SEQ ID NO: 20642 - DNA, 60 bp, Artificial Sequence
  Description of Artificial Sequence: Synthetic probe
ggtattgcgattaacaggtataatggattgacgcttcgcggagttacgatgcgcccgaca

SEQ ID NO: 20643 - DNA, 60 bp, Artificial Sequence
  Description of Artificial Sequence: Synthetic probe
gggtattgcgattaacaggtataatggattgacgcttcgtggagttacgatgcgcccgac

SEQ ID NO: 20644 - DNA, 60 bp, Artificial Sequence
  Description of Artificial Sequence: Synthetic probe
ttaggtattgcgattaacaggtataatggattgacgcttcgcggagttacgatgcgcccg

SEQ ID NO: 20645 - DNA, 60 bp, Artificial Sequence
  Description of Artificial Sequence: Synthetic probe
ggagagagtcgaagagctaagtctggttcgtgtggatgatacgatttcgcaaccaccgag

SEQ ID NO: 20646 - DNA, 60 bp, Artificial Sequence
  Description of Artificial Sequence: Synthetic probe
cgcgacttcaggcaaacatggggcagtttcgcgcggcgttacgacgtatcatggatgacg

SEQ ID NO: 20647 - DNA, 51 bp, Artificial Sequence
  Description of Artificial Sequence: Synthetic probe
aagttcggttgcaaggtattaggagatcgtttagacgtaccactcttctta

SEQ ID NO: 20648 - DNA, 60 bp, Artificial Sequence
  Description of Artificial Sequence: Synthetic probe
aactgcggtagtgtgtggtccggatatggttcaagtgtcactgaatgctggagcaagagg

SEQ ID NO: 20649 - DNA, 60 bp, Artificial Sequence
  Description of Artificial Sequence: Synthetic probe
tacacatgacgttgttggttgccgctgtagtagcattgttgacgtcagtatgcacgcttt

SEQ ID NO: 20650 - DNA, 60 bp, Artificial Sequence
  Description of Artificial Sequence: Synthetic probe
cgctcaaaatgggcaccaagctggctgcgccaactgtgtagatgtgcgaccaatctatgc

SEQ ID NO: 20651 - DNA, 60 bp, Artificial Sequence
  Description of Artificial Sequence: Synthetic probe
tcgctcaagatgggcaccaagctggctgcgccaactgtgtagatgtgcgaccgatctatg

SEQ ID NO: 20652 - DNA, 60 bp, Artificial Sequence
  Description of Artificial Sequence: Synthetic probe
ccaatcgctcaagatgggcaccaagctggctgcgccaactgtgtagatgtgcgaccaatc

SEQ ID NO: 20653 - DNA, 60 bp, Artificial Sequence
  Description of Artificial Sequence: Synthetic probe
gcgcgccgctcaagcagtaactgcagtagtgtgcggtccggatatgattcaagtgtcact

SEQ ID NO: 20654 - DNA, 60 bp, Artificial Sequence
  Description of Artificial Sequence: Synthetic probe
gcttaaagaagaaaagagctataatacatatgacattactgatagcggctgtggttgctc

SEQ ID NO: 20655 - DNA, 60 bp, Artificial Sequence
  Description of Artificial Sequence: Synthetic probe
aggcttaaagaagaaaagagctataatacatatgacactactgatagcggcggttgttgc

SEQ ID NO: 20656 - DNA, 60 bp, Artificial Sequence
  Description of Artificial Sequence: Synthetic probe
cgctatgcggcggttattcggatggattgctttggtacctgccaattacacatccctcga

SEQ ID NO: 20657 - DNA, 60 bp, Artificial Sequence
  Description of Artificial Sequence: Synthetic probe
ccagggataccagaagttgaaagaagggttggtacaagttcgaattgaagggaagacgcc

SEQ ID NO: 20658 - DNA, 60 bp, Artificial Sequence
  Description of Artificial Sequence: Synthetic probe
ggaggcacatctcaggggttgtttcgatttgcgtgagccagggtggacaactgagggtgc

SEQ ID NO: 20659 - DNA, 60 bp, Artificial Sequence
  Description of Artificial Sequence: Synthetic probe
acttcgctgggttcgctgcacctgcctgtgagagtggggaagttatcaatctcgctgcgc

SEQ ID NO: 20660 - DNA, 60 bp, Artificial Sequence
  Description of Artificial Sequence: Synthetic probe
atgcggaaaaggttcacttcgctgggttcgctgcacctgcctgtgagagtggggaagtta

SEQ ID NO: 20661 - DNA, 60 bp, Artificial Sequence
  Description of Artificial Sequence: Synthetic probe
ggcaaccgacgcggaggagccagcgaaagcgtataaattagttgagttggcaaaggaggc

SEQ ID NO: 20662 - DNA, 60 bp, Artificial Sequence
  Description of Artificial Sequence: Synthetic probe
atcgcggcaaccgacgcggaggagccagcgaaagcgtataaattagttgagttggcaaag

SEQ ID NO: 20663 - DNA, 60 bp, Artificial Sequence
  Description of Artificial Sequence: Synthetic probe
atgcctgggccgctcacacgtgctattgcacgcgccgcctatgtgtaatccactttgcac

SEQ ID NO: 20664 - DNA, 60 bp, Artificial Sequence
  Description of Artificial Sequence: Synthetic probe
cgatgccagggccgctcacacgtgctattgcacgcgccgcctatgtgtagtccactttgc

SEQ ID NO: 20665 - DNA, 60 bp, Artificial Sequence
  Description of Artificial Sequence: Synthetic probe
cgtctatagcttcagagatcatacttggcatggactaaggaccgctatattaaatagaac

SEQ ID NO: 20666 - DNA, 57 bp, Artificial Sequence
  Description of Artificial Sequence: Synthetic probe
ctgtgatgcgagcatgtgctacgcttcaagaagcaagaattgtgttggaagctaatg

SEQ ID NO: 20667 - DNA, 54 bp, Artificial Sequence
  Description of Artificial Sequence: Synthetic probe
ctgtgatgcgagcatgtgctacgcttcaagaagcaagaattgtgttggaagcta

SEQ ID NO: 20668 - DNA, 60 bp, Artificial Sequence
  Description of Artificial Sequence: Synthetic probe
tctcagccgccaagatatgctccgggcgcgccaatgccatcatctatgcccactgttgca

SEQ ID NO: 20669 - DNA, 60 bp, Artificial Sequence
  Description of Artificial Sequence: Synthetic probe
agaggcaatgttctaaaagaattggaagctggaattaactggaatttagacgaagggggt

SEQ ID NO: 20670 - DNA, 58 bp, Artificial Sequence
  Description of Artificial Sequence: Synthetic probe
agaggcaatgttctaaaagaattggaagctggaattaactggaatttagacgaagggg

SEQ ID NO: 20671 - DNA, 60 bp, Artificial Sequence
  Description of Artificial Sequence: Synthetic probe
ccaaagagatgattccaggaactagcagattggaaaaactacgtgaagcgagaggcaatg

SEQ ID NO: 20672 - DNA, 60 bp, Artificial Sequence
  Description of Artificial Sequence: Synthetic probe
gctgctgtggttgcgctgttgacatcagtgtgcaccctttcaagcgatatgagtgtggcc

SEQ ID NO: 20673 - DNA, 60 bp, Artificial Sequence
  Description of Artificial Sequence: Synthetic probe
cgaatgagaaaggtggattatcatacgcaacaatcaagtacgctactgagaccacaattt

SEQ ID NO: 20674 - DNA, 60 bp, Artificial Sequence
  Description of Artificial Sequence: Synthetic probe
gggtaaggtttggcggtgtgttacgcactgtacgcgttaaattcttcgacgcgcggcccc

SEQ ID NO: 20675 - DNA, 60 bp, Artificial Sequence
  Description of Artificial Sequence: Synthetic probe
ttgggtaaggtttggcggtgtgttacgcactgtacgcgttaaattcttcgacgcgcggcc

SEQ ID NO: 20676 - DNA, 60 bp, Artificial Sequence
  Description of Artificial Sequence: Synthetic probe
ccgagcggctttaagacgtattatggatgatgacgattgggtaaggtttggcggtgtgtt

SEQ ID NO: 20677 - DNA, 60 bp, Artificial Sequence
  Description of Artificial Sequence: Synthetic probe
aggaggcatgggctgctgcaaacgattttgaagatctaatgcttactgatcaagtttaca

SEQ ID NO: 20678 - DNA, 60 bp, Artificial Sequence
  Description of Artificial Sequence: Synthetic probe
ctcccatcactgcagccatcgttaaagctcgtgttggaggaggaggcatgggctgctgca

SEQ ID NO: 20679 - DNA, 60 bp, Artificial Sequence
  Description of Artificial Sequence: Synthetic probe
ggatgggctacaatagatgttgagtacagagatccagccccttatgtgcatgcacagcgc

SEQ ID NO: 20680 - DNA, 60 bp, Artificial Sequence
  Description of Artificial Sequence: Synthetic probe
gatcccggcgagaggatggatccggcagtgaggatggtcgctggtgttgtaggtcattta

SEQ ID NO: 20681 - DNA, 60 bp, Artificial Sequence
  Description of Artificial Sequence: Synthetic probe
cttgatctaaaaattgatcccggcgagaggatggatccggcagtgaggatggtcgctggt

SEQ ID NO: 20682 - DNA, 60 bp, Artificial Sequence
  Description of Artificial Sequence: Synthetic probe
taacggaagatgagcccgaaaagttctattcaaccataattaagaaggtacggtttatac

SEQ ID NO: 20683 - DNA, 60 bp, Artificial Sequence
  Description of Artificial Sequence: Synthetic probe
caggatcgcgatggatgaacttggcattccgatttatggacgtaactacccagagcattt

SEQ ID NO: 20684 - DNA, 60 bp, Artificial Sequence
  Description of Artificial Sequence: Synthetic probe
gttaaaacaggatcgcgatggatgaacttggcattccgatttatggacgtaactacccag

SEQ ID NO: 20685 - DNA, 60 bp, Artificial Sequence
  Description of Artificial Sequence: Synthetic probe
gctcgaggattaccgcaagagtgggatgatggatgaggccgtgaagcaatccgcattggt

SEQ ID NO: 20686 - DNA, 60 bp, Artificial Sequence
  Description of Artificial Sequence: Synthetic probe
acaatcgctcaaaatgggcaccaagctggcagcgccgactgtgtagagacgcgacctatc

SEQ ID NO: 20687 - DNA, 60 bp, Artificial Sequence
  Description of Artificial Sequence: Synthetic probe
cttaaaatcaccttagacgaacattactcagtcaatcaccagctgtttaattgtatagtg

SEQ ID NO: 20688 - DNA, 60 bp, Artificial Sequence
  Description of Artificial Sequence: Synthetic probe
tagtcgccgctgttgtagcgttgttgacgtcggtatgtaccctctcaagtgatatgagcg

SEQ ID NO: 20689 - DNA, 60 bp, Artificial Sequence
  Description of Artificial Sequence: Synthetic probe
tacacatgacgttgttagtcgccgctgttgtagcgttgttgacgtcggtatgcacgcttt

SEQ ID NO: 20690 - DNA, 60 bp, Artificial Sequence
  Description of Artificial Sequence: Synthetic probe
tatcagcccggtcgttggtttatgcgagctgcgcaggctgtaacagccgtggtgtgtggc

SEQ ID NO: 20691 - DNA, 60 bp, Artificial Sequence
  Description of Artificial Sequence: Synthetic probe
tatcagcccggtcgttggtttatgcgagctgcgcaggctgtaaccgctgtggtgtgtggc

SEQ ID NO: 20692 - DNA, 60 bp, Artificial Sequence
  Description of Artificial Sequence: Synthetic probe
taatcaggagagagtcgaagagctaagtctggttcgtgtggatgatacaatttcacaacc

SEQ ID NO: 20693 - DNA, 60 bp, Artificial Sequence
  Description of Artificial Sequence: Synthetic probe
cgaactctagcgcgcgcattacagagggaaacaacggagagaacagagacggagtcaacg

SEQ ID NO: 20694 - DNA, 60 bp, Artificial Sequence
  Description of Artificial Sequence: Synthetic probe
aaaacgagcagatgcgaactctagcgcgcgcattacagagggaaacaacggagagaacag

SEQ ID NO: 20695 - DNA, 51 bp, Artificial Sequence
  Description of Artificial Sequence: Synthetic probe
ttgagaaaatacaacatcagtggggattacgcaaatgccacgagaactttt

SEQ ID NO: 20696 - DNA, 60 bp, Artificial Sequence
  Description of Artificial Sequence: Synthetic probe
ccattgtatctcacatcatcatgcgaatgaatctttctttcttggatttgatttaagtat

SEQ ID NO: 20697 - DNA, 60 bp, Artificial Sequence
  Description of Artificial Sequence: Synthetic probe
ctaccttcgttacaaccgtcgcttaaactggcattagaagaagaagcttgggctgcggcg

SEQ ID NO: 20698 - DNA, 60 bp, Artificial Sequence
  Description of Artificial Sequence: Synthetic probe
cacccaatcgctcaaaatgggcaccaagctggctgcgccaactgtgtagatgtgcgacca

SEQ ID NO: 20699 - DNA, 60 bp, Artificial Sequence
  Description of Artificial Sequence: Synthetic probe
acttagaaggagagcctgcaacgaaggtatttcactgggagtacgaattgattaataaag

SEQ ID NO: 20700 - DNA, 51 bp, Artificial Sequence
  Description of Artificial Sequence: Synthetic probe
gagcgtgagacctgaatataaaccgcgagatttggagcgggaacaggaaaa

SEQ ID NO: 20701 - DNA, 60 bp, Artificial Sequence
  Description of Artificial Sequence: Synthetic probe
gagagaaacgtcatttttacacacaaaacacaccgtacgaatcaagatcgtttttatgtg

SEQ ID NO: 20702 - DNA, 60 bp, Artificial Sequence
  Description of Artificial Sequence: Synthetic probe
gcgacatctttcgttgatgcagaggagattcccggatgttctgatccaagcgagaccctc

SEQ ID NO: 20703 - DNA, 60 bp, Artificial Sequence
  Description of Artificial Sequence: Synthetic probe
cccagtatctcattcagacatatcgtaatgcagtcaagagatcgagtcttacgagtagat

SEQ ID NO: 20704 - DNA, 60 bp, Artificial Sequence
  Description of Artificial Sequence: Synthetic probe
cccagtatttcgttcagacatatcgtaatgcagtcaagagatcgagtcttacgagtagat

SEQ ID NO: 20705 - DNA, 56 bp, Artificial Sequence
  Description of Artificial Sequence: Synthetic probe
caaaggaatgggaattgtacaaccatatatgcggaatgattttgatcggaacgaga

SEQ ID NO: 20706 - DNA, 56 bp, Artificial Sequence
  Description of Artificial Sequence: Synthetic probe
caaaggaatgggaattgtgcagccatatatgcggaatgattttgatcggaacgaga

SEQ ID NO: 20707 - DNA, 60 bp, Artificial Sequence
  Description of Artificial Sequence: Synthetic probe
aggtttacgtcgcgcagggtggttgacctcgcggcgtagactcccactgctgtataacgg

SEQ ID NO: 20708 - DNA, 60 bp, Artificial Sequence
  Description of Artificial Sequence: Synthetic probe
cgccccgaggtttacgtcgcgcagggtggttgacctcgcggcgtagactcccactgctgt

SEQ ID NO: 20709 - DNA, 60 bp, Artificial Sequence
  Description of Artificial Sequence: Synthetic probe
atatactgtgctacgaccggaatttgctatacatggggtaaatccaatgcctggcccgct

SEQ ID NO: 20710 - DNA, 60 bp, Artificial Sequence
  Description of Artificial Sequence: Synthetic probe
cctccaaacgaccgagatagtatattgacccttttgttgctgtcgactttagctgatgta

SEQ ID NO: 20711 - DNA, 60 bp, Artificial Sequence
  Description of Artificial Sequence: Synthetic probe
ttcacaacggaagctgcgaacgagattgcgcgtgtaacaggggaaacgtcgacgtgggga

SEQ ID NO: 20712 - DNA, 60 bp, Artificial Sequence
  Description of Artificial Sequence: Synthetic probe
acgccagagattcctttcacaacggaagctgcgaacgagattgcgcgtgtaacaggggaa

SEQ ID NO: 20713 - DNA, 60 bp, Artificial Sequence
  Description of Artificial Sequence: Synthetic probe
ccgaccagagatcatcgcggcatggaggtcgcagagccagaagtgctgggagtggaattt

SEQ ID NO: 20714 - DNA, 60 bp, Artificial Sequence
  Description of Artificial Sequence: Synthetic probe
gtgacagcggtagtgtgcggtccggatatgattcaagtgtcactgaatgctggggcaaga

SEQ ID NO: 20715 - DNA, 60 bp, Artificial Sequence
  Description of Artificial Sequence: Synthetic probe
ctcaatggacttgcagtcatttgaaaaggaattgtttatttaatgggatgtgtgtcaagc

SEQ ID NO: 20716 - DNA, 60 bp, Artificial Sequence
  Description of Artificial Sequence: Synthetic probe
acctcaatggacttgtagtcacttaaaaaggaattgtttatttaatgggatgtgtgtcaa

SEQ ID NO: 20717 - DNA, 60 bp, Artificial Sequence
  Description of Artificial Sequence: Synthetic probe
cgcaagtacaaacgatgataacgaaggtgagtagaggattttgtcatgatttagcgcagt

SEQ ID NO: 20718 - DNA, 60 bp, Artificial Sequence
  Description of Artificial Sequence: Synthetic probe
actatagcgaatacgatacacacctaacgcgacataattttcgaaccggtatgctccaag

SEQ ID NO: 20719 - DNA, 60 bp, Artificial Sequence
  Description of Artificial Sequence: Synthetic probe
cgaactgagtgtagaattaaagcatattcccttagggatgcaagttatggctgacttcgt

SEQ ID NO: 20720 - DNA, 60 bp, Artificial Sequence
  Description of Artificial Sequence: Synthetic probe
gttaaaaagtgtacccttagcgaagatgggtaaagtcatacgatctctgagtagattcgg

SEQ ID NO: 20721 - DNA, 60 bp, Artificial Sequence
  Description of Artificial Sequence: Synthetic probe
gttaaaaagtgtacccttagcgaagatgggtaaagtcatacgatctctaagccgattcgg

SEQ ID NO: 20722 - DNA, 60 bp, Artificial Sequence
  Description of Artificial Sequence: Synthetic probe
gttaaaaagtgtacccttagcgaagatgggtaaaatcatacgatctctgagcagatttgg

SEQ ID NO: 20723 - DNA, 60 bp, Artificial Sequence
  Description of Artificial Sequence: Synthetic probe
actgttaccgtcggaggtgttgatatgagggcgggacgcataaccgcgtgggatgggcaa

SEQ ID NO: 20724 - DNA, 60 bp, Artificial Sequence
  Description of Artificial Sequence: Synthetic probe
ccgtgactgttaccgtcggaggtgttgatatgagggcgggacgcataaccgcgtgggatg

SEQ ID NO: 20725 - DNA, 60 bp, Artificial Sequence
  Description of Artificial Sequence: Synthetic probe
ttaggtattgcgattaacagatataatggattgacgcttcgtggagttacaatgcgcccg

SEQ ID NO: 20726 - DNA, 60 bp, Artificial Sequence
  Description of Artificial Sequence: Synthetic probe
gaagtcggagctgagaagcagtttgatatcttaagtaaggcagttaattcatacaataag

SEQ ID NO: 20727 - DNA, 60 bp, Artificial Sequence
  Description of Artificial Sequence: Synthetic probe
gaagaagtcggagctgagaagcagtttgatatcttaagtaaggcagttaattcatacaat

SEQ ID NO: 20728 - DNA, 57 bp, Artificial Sequence
  Description of Artificial Sequence: Synthetic probe
gcggaagcgtttcgtgatgatgtgagactgagacagattaaacgccatgtgaatgag

SEQ ID NO: 20729 - DNA, 60 bp, Artificial Sequence
  Description of Artificial Sequence: Synthetic probe
atcatataatgacgcggtgaggatgagttttacagagttctcgtcaatcccgctggatgg

SEQ ID NO: 20730 - DNA, 60 bp, Artificial Sequence
  Description of Artificial Sequence: Synthetic probe
atcttataatgacgcggtgaggatgagttttacagagttctcgtcaatcccgctggatgg

SEQ ID NO: 20731 - DNA, 60 bp, Artificial Sequence
  Description of Artificial Sequence: Synthetic probe
caatcttataatgacgcggtgaggatgagttttacagagttctcgtcaatcccgctggat

SEQ ID NO: 20732 - DNA, 58 bp, Artificial Sequence
  Description of Artificial Sequence: Synthetic probe
acataccactcttcttaagaaatgcctgaacgcagcgacgggaagcgcctacacttac

SEQ ID NO: 20733 - DNA, 60 bp, Artificial Sequence
  Description of Artificial Sequence: Synthetic probe
gatcctgggtgcgttaaagtttggatgtaagatcttaggggatccaatagacataccact

SEQ ID NO: 20734 - DNA, 60 bp, Artificial Sequence
  Description of Artificial Sequence: Synthetic probe
gcagatgcacatattacggggaccactacactttcaaaggcgagcgatcctgggtgcgtt

SEQ ID NO: 20735 - DNA, 60 bp, Artificial Sequence
  Description of Artificial Sequence: Synthetic probe
ggtgcaccccatttatttgggatcgctccattacgatgtgtctttcgcagacttacgtgg

SEQ ID NO: 20736 - DNA, 60 bp, Artificial Sequence
  Description of Artificial Sequence: Synthetic probe
aattacggtactcagatgcacacgcggaggatgataagatctaagacggtgcaccccatt

SEQ ID NO: 20737 - DNA, 60 bp, Artificial Sequence
  Description of Artificial Sequence: Synthetic probe
atttaagtattgatctagttcactatgaggacctgaccgcgcattggcacgctttagggg

SEQ ID NO: 20738 - DNA, 60 bp, Artificial Sequence
  Description of Artificial Sequence: Synthetic probe
acgaaatcttgccaagattcaaaaaagcgatggaagaagagaaggagatttgtgggatag

SEQ ID NO: 20739 - DNA, 60 bp, Artificial Sequence
  Description of Artificial Sequence: Synthetic probe
gataaagcgttggctgtaagtgttttatcgaaaaatcggacaattcaagagaaccacaaa

SEQ ID NO: 20740 - DNA, 60 bp, Artificial Sequence
  Description of Artificial Sequence: Synthetic probe
aaccgagcgttgtatctaccatacttgagtatcgtgcaagggatgtaccggataaagcgt

SEQ ID NO: 20741 - DNA, 60 bp, Artificial Sequence
  Description of Artificial Sequence: Synthetic probe
aaatgcgctgagcggaattgatttgactcatctacgcactccgaagatcgaaccgagcgt

SEQ ID NO: 20742 - DNA, 60 bp, Artificial Sequence
  Description of Artificial Sequence: Synthetic probe
gtagctacggggagagcgattgagggagcttataagctcaaaaaagttataaatgcgctg

SEQ ID NO: 20743 - DNA, 60 bp, Artificial Sequence
  Description of Artificial Sequence: Synthetic probe
aggttccattgattggagcgggaatggcgacagccgtagctacggggagagcgattgagg

SEQ ID NO: 20744 - DNA, 60 bp, Artificial Sequence
  Description of Artificial Sequence: Synthetic probe
aggctgcttcagaggaggttccattgattggagcgggaatggcgacagccgtagctacgg

SEQ ID NO: 20745 - DNA, 60 bp, Artificial Sequence
  Description of Artificial Sequence: Synthetic probe
gcaagaagaagcaatacaggagattgcgggtatgaccgctgatgtgttagaggctgcttc

SEQ ID NO: 20746 - DNA, 60 bp, Artificial Sequence
  Description of Artificial Sequence: Synthetic probe
gctttgaagaacgcgattgaagttgagcgagatgggatgcaagaagaagcaatacaggag

SEQ ID NO: 20747 - DNA, 60 bp, Artificial Sequence
  Description of Artificial Sequence: Synthetic probe
agtaagatcgaggctttgaagaacgcgattgaagttgagcgagatgggatgcaagaagaa

SEQ ID NO: 20748 - DNA, 60 bp, Artificial Sequence
  Description of Artificial Sequence: Synthetic probe
cgcacacggagacgacgatggtgaaggaatatagaagtaagatcgaggctttgaagaacg

SEQ ID NO: 20749 - DNA, 60 bp, Artificial Sequence
  Description of Artificial Sequence: Synthetic probe
agattggagatagaacgcacacggagacgacgatggtgaaggaatatagaagtaagatcg

SEQ ID NO: 20750 - DNA, 56 bp, Artificial Sequence
  Description of Artificial Sequence: Synthetic probe
agtgaactcatatgacaaaatcctagcggaggaagatacgcaaatgaggcgtttgg

SEQ ID NO: 20751 - DNA, 60 bp, Artificial Sequence
  Description of Artificial Sequence: Synthetic probe
gcgaaggacgaggagggcgaagagaaacagtttgatatattgaacaaggcagtgaactca

SEQ ID NO: 20752 - DNA, 60 bp, Artificial Sequence
  Description of Artificial Sequence: Synthetic probe
gggaagagttagaacaagtttacgactttatgaatggggttgcgaaggacgaggagggcg

SEQ ID NO: 20753 - DNA, 57 bp, Artificial Sequence
  Description of Artificial Sequence: Synthetic probe
aacgaagttaagagaattagaggatgagcagagaaacgagttggttcgtcttaaata

SEQ ID NO: 20754 - DNA, 60 bp, Artificial Sequence
  Description of Artificial Sequence: Synthetic probe
gtgaggaaattcctgacccattgagcccaggcgaacgtggaattcaaacgaagttaagag

SEQ ID NO: 20755 - DNA, 60 bp, Artificial Sequence
  Description of Artificial Sequence: Synthetic probe
aatcatatggggagtcagtaaagcaagcggtgttattaaatgttttaggaagtggtgagg

SEQ ID NO: 20756 - DNA, 60 bp, Artificial Sequence
  Description of Artificial Sequence: Synthetic probe
ggcttagtgcaagggagcgttcattcaataataactggtaaatcatatggggagtcagta

SEQ ID NO: 20757 - DNA, 60 bp, Artificial Sequence
  Description of Artificial Sequence: Synthetic probe
acgattggaaaggcggctgaacggtttgcagaaagtgaaatcgggtccgcagcgatagat

SEQ ID NO: 20758 - DNA, 60 bp, Artificial Sequence
  Description of Artificial Sequence: Synthetic probe
gcgaagatgggtaaagtcatacgatccctaagtcggtttggtaagaaagttggaaatgcg

SEQ ID NO: 20759 - DNA, 60 bp, Artificial Sequence
  Description of Artificial Sequence: Synthetic probe
attcgcatcgtacgcagaagcgtttcgtgatgacgtaagactaagacagattaaacgcca

SEQ ID NO: 20760 - DNA, 60 bp, Artificial Sequence
  Description of Artificial Sequence: Synthetic probe
cgcatgggatgggcaggcggtgctacaaattcacaatccgactcaacaaaatgctatggt

SEQ ID NO: 20761 - DNA, 60 bp, Artificial Sequence
  Description of Artificial Sequence: Synthetic probe
atcgcatgggatgggcaggcggtgctacaaattcacaatccgactcaacaaaatgctatg

SEQ ID NO: 20762 - DNA, 60 bp, Artificial Sequence
  Description of Artificial Sequence: Synthetic probe
cggaaaggtgggaagagtggaagtttgaaggtgttagtgtgacgccaatggctactaggg

SEQ ID NO: 20763 - DNA, 60 bp, Artificial Sequence
  Description of Artificial Sequence: Synthetic probe
cgagatgttacgcatgctggttgccgcaggtaaagattcggaggcggcgtattttcgcag

SEQ ID NO: 20764 - DNA, 60 bp, Artificial Sequence
  Description of Artificial Sequence: Synthetic probe
cgcatcgtacgcagaagcgtttcgtgatgatgtgaggttgagacaaattaaacgccatgt

SEQ ID NO: 20765 - DNA, 60 bp, Artificial Sequence
  Description of Artificial Sequence: Synthetic probe
cgcatcgtacgcagaagcgtttcgtgatgatgtgaggttgagacaaattaaacggcatgt

SEQ ID NO: 20766 - DNA, 60 bp, Artificial Sequence
  Description of Artificial Sequence: Synthetic probe
agctactactcttccaattttaatttgacaatatggctgcgaactcaacttcgcgatagc

SEQ ID NO: 20767 - DNA, 60 bp, Artificial Sequence
  Description of Artificial Sequence: Synthetic probe
gagagattgagagatctgcggcgaaaagagaagaatgggacgcatgctaaagctgttgag

SEQ ID NO: 20768 - DNA, 60 bp, Artificial Sequence
  Description of Artificial Sequence: Synthetic probe
cggaaaatggggataagagagggagcctcgatcgattcgtggctagaattactgcgtcac

SEQ ID NO: 20769 - DNA, 60 bp, Artificial Sequence
  Description of Artificial Sequence: Synthetic probe
acaaacggaaaatggggataagagagggagcctcgatcgattcgtggctagaattactgc

SEQ ID NO: 20770 - DNA, 60 bp, Artificial Sequence
  Description of Artificial Sequence: Synthetic probe
acgatatgtttaacgcattattacccgaccttatcgctggggcgcatcagaacgctgacc

SEQ ID NO: 20771 - DNA, 60 bp, Artificial Sequence
  Description of Artificial Sequence: Synthetic probe
tgacaagacgcgatttcctaacgcgcgatcgtagcatcgtggaagcgcgggtgaggagat

SEQ ID NO: 20772 - DNA, 58 bp, Artificial Sequence
  Description of Artificial Sequence: Synthetic probe
tttgggtcttagctttacagctgccggttaatccgcaagtagtgtgggatgtgccacg

SEQ ID NO: 20773 - DNA, 60 bp, Artificial Sequence
  Description of Artificial Sequence: Synthetic probe
cggggatggctacggctgtggcgacaggtagggctatagagggagcgtataagctcaaga

SEQ ID NO: 20774 - DNA, 60 bp, Artificial Sequence
  Description of Artificial Sequence: Synthetic probe
ggcagagcgattcgctgaaagtgagataggctcagcggcgatcgatgggttggtacaggg

SEQ ID NO: 20775 - DNA, 60 bp, Artificial Sequence
  Description of Artificial Sequence: Synthetic probe
cccaaccgtatgaagaggacatcgaaggaaagatgaagaggtgtggtgtacagctgctcg

SEQ ID NO: 20776 - DNA, 60 bp, Artificial Sequence
  Description of Artificial Sequence: Synthetic probe
gatccaaatagaatgacagttagaaatctcgagaaccaattcgtttgagagcacgcgccg

SEQ ID NO: 20777 - DNA, 60 bp, Artificial Sequence
  Description of Artificial Sequence: Synthetic probe
cgcaagtacaaacgatgataacgaaagtgagtagaggattttgtcacgatttggcgcagc

SEQ ID NO: 20778 - DNA, 60 bp, Artificial Sequence
  Description of Artificial Sequence: Synthetic probe
ccgatcaaggccacaagaacgatatactcaatcaatctttcagtgctggtaccgcagttg

SEQ ID NO: 20779 - DNA, 60 bp, Artificial Sequence
  Description of Artificial Sequence: Synthetic probe
gtgttttatgacaagtttcgaactgagccgaatcgatacaaagccctatttcgatcgtcg

SEQ ID NO: 20780 - DNA, 60 bp, Artificial Sequence
  Description of Artificial Sequence: Synthetic probe
atgtgttttatgacaagtttcgaactgagccgaatcgatacaaagccctatttcgatcgt

SEQ ID NO: 20781 - DNA, 52 bp, Artificial Sequence
  Description of Artificial Sequence: Synthetic probe
ttggaattcggtgatatgaagattgacccagttggactattgcgtgagtttt

SEQ ID NO: 20782 - DNA, 60 bp, Artificial Sequence
  Description of Artificial Sequence: Synthetic probe
ttcaagggagatgactgaactggaaaaatttattgaatttcgtgctaaaaacgagatgca

SEQ ID NO: 20783 - DNA, 60 bp, Artificial Sequence
  Description of Artificial Sequence: Synthetic probe
ccttgaaatactggacaaagcgatgtcaaactcaactggtgcaacgcaaacacaaaaagc

SEQ ID NO: 20784 - DNA, 57 bp, Artificial Sequence
  Description of Artificial Sequence: Synthetic probe
ccttgaaatactggacaaagcgatgtcaaactcaactggtgcaacgcaaacacaaaa

SEQ ID NO: 20785 - DNA, 60 bp, Artificial Sequence
  Description of Artificial Sequence: Synthetic probe
gagagattgagagatctgcggcggaaagagaagaatgggacgtatgctaaagccgttgag

SEQ ID NO: 20786 - DNA, 60 bp, Artificial Sequence
  Description of Artificial Sequence: Synthetic probe
caagtttcaatgcgtttgggagaggagtctggagtaatatcgacatcttatgcgaaactc

SEQ ID NO: 20787 - DNA, 60 bp, Artificial Sequence
  Description of Artificial Sequence: Synthetic probe
ccgagcagacggagagattgagagatctgcggcgaaaagagaagaatgggacgcatgcta

SEQ ID NO: 20788 - DNA, 60 bp, Artificial Sequence
  Description of Artificial Sequence: Synthetic probe
gttgggaatttcccgtgagggagtggctgagcagacggagagattgagagatctgcggcg

SEQ ID NO: 20789 - DNA, 60 bp, Artificial Sequence
  Description of Artificial Sequence: Synthetic probe
cagagatcacacatggcacgggttgaggacggctatactaaacagaactacactgccgaa

SEQ ID NO: 20790 - DNA, 60 bp, Artificial Sequence
  Description of Artificial Sequence: Synthetic probe
cgaggccgtctcatttctggaaggcggtactaaatgatagccccgaagcggtcaaagccg

SEQ ID NO: 20791 - DNA, 60 bp, Artificial Sequence
  Description of Artificial Sequence: Synthetic probe
tgtgaggctgaggcagatcaaccgtcatgttaatgaacagattttcccaaagttaaagag

SEQ ID NO: 20792 - DNA, 60 bp, Artificial Sequence
  Description of Artificial Sequence: Synthetic probe
tgatgatgtgaggctgaggcagatcaaccgtcatgttaatgaacagattttcccaaagtt

SEQ ID NO: 20793 - DNA, 60 bp, Artificial Sequence
  Description of Artificial Sequence: Synthetic probe
taaccaggagagagttgaagaactaagtctagtacgcgtggatgatacaatttcacaacc

SEQ ID NO: 20794 - DNA, 60 bp, Artificial Sequence
  Description of Artificial Sequence: Synthetic probe
agaagcgagcaatcatacacaccactctgttagtagctgctgtggttgcgctgttgacat

SEQ ID NO: 20795 - DNA, 60 bp, Artificial Sequence
  Description of Artificial Sequence: Synthetic probe
gctcgaagattaccgtaaaagtgggatgatggatgaggccgtgaagcaatccgcattggt

SEQ ID NO: 20796 - DNA, 60 bp, Artificial Sequence
  Description of Artificial Sequence: Synthetic probe
gctcgaggattaccgtaaaagtgggatgatggatgaggccgtgaagcaatccgcattggt

SEQ ID NO: 20797 - DNA, 60 bp, Artificial Sequence
  Description of Artificial Sequence: Synthetic probe
caactgctcgaagattaccgtaaaagtgggatgatggatgaggccgtgaagcaatccgca

SEQ ID NO: 20798 - DNA, 60 bp, Artificial Sequence
  Description of Artificial Sequence: Synthetic probe
gcgaaggctgctgagagaggaaggcgtaaacaagggaagaagcctcaaggcgatgcgcag

SEQ ID NO: 20799 - DNA, 60 bp, Artificial Sequence
  Description of Artificial Sequence: Synthetic probe
ttgcgcaaaagagccagcgtaatgatcaggatcggttctatgtgctgatggtgatagccg

SEQ ID NO: 20800 - DNA, 60 bp, Artificial Sequence
  Description of Artificial Sequence: Synthetic probe
gcggtgaggatgagttttacagagttctcgtcaatcccgctggacggtttcgaaatgcca

SEQ ID NO: 20801 - DNA, 60 bp, Artificial Sequence
  Description of Artificial Sequence: Synthetic probe
caatcttacaatgatgcggtgaggatgagttttacagagttctcgtcaatcccgctggat

SEQ ID NO: 20802 - DNA, 60 bp, Artificial Sequence
  Description of Artificial Sequence: Synthetic probe
ggctgctgagaaaggaaggcgtaaacaggggaagagagctcaaggtgacgcgcagaagga

SEQ ID NO: 20803 - DNA, 60 bp, Artificial Sequence
  Description of Artificial Sequence: Synthetic probe
cgcgtgtgcaggttaattatggccctacaggggagccgttggatttccagatcggcagga

SEQ ID NO: 20804 - DNA, 60 bp, Artificial Sequence
  Description of Artificial Sequence: Synthetic probe
gtatgtctagcggcgcttgcacggggcgcactggccatacctgagtgtcggttgtgggaa

SEQ ID NO: 20805 - DNA, 60 bp, Artificial Sequence
  Description of Artificial Sequence: Synthetic probe
cgcgctgcgcatggcaattctgaatcgtacgactttacctggtgtgctacctcccatatt

SEQ ID NO: 20806 - DNA, 60 bp, Artificial Sequence
  Description of Artificial Sequence: Synthetic probe
atgctcagggaaattcagttcagacacaggcaggagttacggtgagcatcgggggtgtga

SEQ ID NO: 20807 - DNA, 60 bp, Artificial Sequence
  Description of Artificial Sequence: Synthetic probe
ccaatgaggttgcgcgagtggcaggtgagacgtcaacgtggggaccggcgcgccaggctt

SEQ ID NO: 20808 - DNA, 60 bp, Artificial Sequence
  Description of Artificial Sequence: Synthetic probe
atcgaaaaggtatgagttgcagtgtgtgggtgcgtgtgagcgtgttgcttttgtctctaa

SEQ ID NO: 20809 - DNA, 60 bp, Artificial Sequence
  Description of Artificial Sequence: Synthetic probe
ggtgatctaagtggattgaagaagaagcgagcgatcatacatactactctactggtagct

SEQ ID NO: 20810 - DNA, 58 bp, Artificial Sequence
  Description of Artificial Sequence: Synthetic probe
tgtaaggggatgggaatcgtccaaccgtatatgagaaatgattttgaccgaaatgaga

SEQ ID NO: 20811 - DNA, 60 bp, Artificial Sequence
  Description of Artificial Sequence: Synthetic probe
gcagaagatggggaagataattaaatcgctaagtagatttggaaagaaagttggaaacgc

SEQ ID NO: 20812 - DNA, 60 bp, Artificial Sequence
  Description of Artificial Sequence: Synthetic probe
tactcgcagaagatggggaagataattaaatcgctaagtagatttggaaagaaagttgga

SEQ ID NO: 20813 - DNA, 60 bp, Artificial Sequence
  Description of Artificial Sequence: Synthetic probe
gcagaagatggggaagataattaaatcgctaagtagatttgggaagaaggttggaaatgc

SEQ ID NO: 20814 - DNA, 60 bp, Artificial Sequence
  Description of Artificial Sequence: Synthetic probe
gcagaagatggggaagataattaaatcgctaagtagatttggaaagaaagttggaagcgc

SEQ ID NO: 20815 - DNA, 60 bp, Artificial Sequence
  Description of Artificial Sequence: Synthetic probe
cctcaaagaagaagaatatattagcttacacgagtacgggaggagatgtgaaaatggagt

SEQ ID NO: 20816 - DNA, 60 bp, Artificial Sequence
  Description of Artificial Sequence: Synthetic probe
tatgctagtttccaacagtatcaaggatgtagcacgagctacggcatattttacggcgcc

SEQ ID NO: 20817 - DNA, 60 bp, Artificial Sequence
  Description of Artificial Sequence: Synthetic probe
gacgcgcagaaggaaggtactgaggaagacaggacatctgaggaaccagcaagcgtcggg

SEQ ID NO: 20818 - DNA, 60 bp, Artificial Sequence
  Description of Artificial Sequence: Synthetic probe
ctaaggctgctgagaaaggaaggcgtaaacaggggaagagagctcaaggtgacgcgcaga

SEQ ID NO: 20819 - DNA, 60 bp, Artificial Sequence
  Description of Artificial Sequence: Synthetic probe
aacagagagattgagagatctgcggcggaaagagaagagtggggcgcatgctaaggctgc

SEQ ID NO: 20820 - DNA, 60 bp, Artificial Sequence
  Description of Artificial Sequence: Synthetic probe
gatcccagctcagatcatcgaagtggaacgcagcctccagaaagaactggggatttcgcg

SEQ ID NO: 20821 - DNA, 60 bp, Artificial Sequence
  Description of Artificial Sequence: Synthetic probe
gaatggaggaagatgggtagttctaacggatgagatcgctcgcgcgatcgagtctaaata

SEQ ID NO: 20822 - DNA, 60 bp, Artificial Sequence
  Description of Artificial Sequence: Synthetic probe
cgacatgtaaatgaacaaatcctgccaaagttgaaaagtgacctaggaggcttaaagaag

SEQ ID NO: 20823 - DNA, 60 bp, Artificial Sequence
  Description of Artificial Sequence: Synthetic probe
cgacatgtaaatgaacaaattctgccaaagttgaaaagtgacctaggaggcttaaagaag

SEQ ID NO: 20824 - DNA, 60 bp, Artificial Sequence
  Description of Artificial Sequence: Synthetic probe
gggatggacaagcggttctgcagatacataatcctacccaacagaatgcaatggtacaga

SEQ ID NO: 20825 - DNA, 60 bp, Artificial Sequence
  Description of Artificial Sequence: Synthetic probe
tgggatggacaagcggttctgcagatacataatcctacccaacagaatgcaatggtacag

SEQ ID NO: 20826 - DNA, 60 bp, Artificial Sequence
  Description of Artificial Sequence: Synthetic probe
gatgtgggatggacaagcggttctgcagatacataatcctactcaacagaatgcaatggt

SEQ ID NO: 20827 - DNA, 60 bp, Artificial Sequence
  Description of Artificial Sequence: Synthetic probe
cgtgggatggacaagcggttctgcagatacataatcctactcaacagaatgcaatggtac

SEQ ID NO: 20828 - DNA, 60 bp, Artificial Sequence
  Description of Artificial Sequence: Synthetic probe
cgcatgggatggacaagcggttctgcagatacataatcctactcaacagaatgcaatggt

SEQ ID NO: 20829 - DNA, 60 bp, Artificial Sequence
  Description of Artificial Sequence: Synthetic probe
atcgcatgggatggacaagcggttctgcagatacataatcctactcaacagaatgcaatg

SEQ ID NO: 20830 - DNA, 60 bp, Artificial Sequence
  Description of Artificial Sequence: Synthetic probe
attgcgtgggatggacaagcggttctgcagatacataatcctactcaacagaatgcaatg

SEQ ID NO: 20831 - DNA, 60 bp, Artificial Sequence
  Description of Artificial Sequence: Synthetic probe
gactaactctacgtggagtaacgatgcgcccgacctcgttagcgcaaaggaatgagatgt

SEQ ID NO: 20832 - DNA, 60 bp, Artificial Sequence
  Description of Artificial Sequence: Synthetic probe
cgaggaagatgtcgaagggaagatgaagcgatgcggagcgcaattgcttgaggattaccg

SEQ ID NO: 20833 - DNA, 50 bp, Artificial Sequence
  Description of Artificial Sequence: Synthetic probe
tgtgttgatatgagggccagacgcataatcgcgtggaattggcaagccgc

SEQ ID NO: 20834 - DNA, 60 bp, Artificial Sequence
  Description of Artificial Sequence: Synthetic probe
ggaatcacacaacgtgctgcggcagttagcgtcgagtgtgttgatatgagggccagacgc

SEQ ID NO: 20835 - DNA, 60 bp, Artificial Sequence
  Description of Artificial Sequence: Synthetic probe
ggattgcgacgtcaggaatcacacaacgtgctgcggcagttagcgtcgagtgtgttgata

SEQ ID NO: 20836 - DNA, 60 bp, Artificial Sequence
  Description of Artificial Sequence: Synthetic probe
gggtggggagcacattcagcgaagatcagagatctgtgggagaaggattgcgacgtcagg

SEQ ID NO: 20837 - DNA, 60 bp, Artificial Sequence
  Description of Artificial Sequence: Synthetic probe
tctgaggggtggggagcacattcagcgaagatcagagatctgtgggagaaggattgcgac

SEQ ID NO: 20838 - DNA, 60 bp, Artificial Sequence
  Description of Artificial Sequence: Synthetic probe
gctagaggtgatgggcaacaatttcagcgagatcgtgtcagtctgaggggtggggagcac

SEQ ID NO: 20839 - DNA, 60 bp, Artificial Sequence
  Description of Artificial Sequence: Synthetic probe
aatgctggtgctagaggtgatgggcaacaatttcagcgagatcgtgtcagtctgaggggt

SEQ ID NO: 20840 - DNA, 60 bp, Artificial Sequence
  Description of Artificial Sequence: Synthetic probe
gcagcaagagcgctcactgtgatgcgagcatgtgtctctcatctagatgcatactctgtg

SEQ ID NO: 20841 - DNA, 60 bp, Artificial Sequence
  Description of Artificial Sequence: Synthetic probe
atggacactatcgcagcaagagcgctcactgtgatgcgagcatgtgtctctcatctagat

SEQ ID NO: 20842 - DNA, 60 bp, Artificial Sequence
  Description of Artificial Sequence: Synthetic probe
ctatctaggttctatgcattatgacatatctttctcagatctgcgtggaaacgcgcaacg

SEQ ID NO: 20843 - DNA, 60 bp, Artificial Sequence
  Description of Artificial Sequence: Synthetic probe
tcccatttatctaggttctatgcattatgacatatctttctcagatttgcgtggaaatgc

SEQ ID NO: 20844 - DNA, 60 bp, Artificial Sequence
  Description of Artificial Sequence: Synthetic probe
aacggtacaccccatctatctaggttctatgcattatgacatatctttctcagatctgcg

SEQ ID NO: 20845 - DNA, 60 bp, Artificial Sequence
  Description of Artificial Sequence: Synthetic probe
tgcggaatcgaagataagactatacaccctaaagttatgatgaaatttaagattccgaga

SEQ ID NO: 20846 - DNA, 60 bp, Artificial Sequence
  Description of Artificial Sequence: Synthetic probe
cagtaggtagagtggcgccctgaggtttgcaccgcatggagtggttgatcctgcgatgca

SEQ ID NO: 20847 - DNA, 51 bp, Artificial Sequence
  Description of Artificial Sequence: Synthetic probe
caggaaaatcataaagagctagtgcacataaaggacgaaatattacctcgc

SEQ ID NO: 20848 - DNA, 58 bp, Artificial Sequence
  Description of Artificial Sequence: Synthetic probe
tcaggaaaatcataaagagctagtgcacataaaggacgaaatattacctcgctttaaa

SEQ ID NO: 20849 - DNA, 60 bp, Artificial Sequence
  Description of Artificial Sequence: Synthetic probe
cccgatagcgcattagcagtgagtgttttatcgaagaatcgtgcaattcaggaaaatcat

SEQ ID NO: 20850 - DNA, 60 bp, Artificial Sequence
  Description of Artificial Sequence: Synthetic probe
agatggacactatcgcagcaagagcgctcactgtaatgcgggcatgtgccactttacaag

SEQ ID NO: 20851 - DNA, 60 bp, Artificial Sequence
  Description of Artificial Sequence: Synthetic probe
agatggacactatcgcagcaagagcgctcactgtaatgcgggcatgtgccactttacagg

SEQ ID NO: 20852 - DNA, 59 bp, Artificial Sequence
  Description of Artificial Sequence: Synthetic probe
ctcggaggcagcgtattttcgcagtatgttacctttccatatggtaagattcgctagaa

SEQ ID NO: 20853 - DNA, 60 bp, Artificial Sequence
  Description of Artificial Sequence: Synthetic probe
aacaatcttataatgacgcggtgaggatgagttttacggagttctcgtcaatcccgctgg

SEQ ID NO: 20854 - DNA, 60 bp, Artificial Sequence
  Description of Artificial Sequence: Synthetic probe
cgcattgtcgtcaaacacagcgaagaaaatttattcaactattggaaaggcagcggagcg

SEQ ID NO: 20855 - DNA, 60 bp, Artificial Sequence
  Description of Artificial Sequence: Synthetic probe
cgcattgtcgtcaaacacagcgaagaaaatttattcaactattgggaaggcagcggagcg

SEQ ID NO: 20856 - DNA, 60 bp, Artificial Sequence
  Description of Artificial Sequence: Synthetic probe
ttggaaacgcattgtcgtcaaacacagcgaagaaaatttattcaactattgggaaggcag

SEQ ID NO: 20857 - DNA, 60 bp, Artificial Sequence
  Description of Artificial Sequence: Synthetic probe
gccttaagcgggatagatctaacacatttgcgtacgccgaaaattgagccgagtgtagtc

SEQ ID NO: 20858 - DNA, 60 bp, Artificial Sequence
  Description of Artificial Sequence: Synthetic probe
aattaatgcattaagcgggatagatctaacacatttgcgtacgccgaaaattgaaccgag

SEQ ID NO: 20859 - DNA, 60 bp, Artificial Sequence
  Description of Artificial Sequence: Synthetic probe
ccctggtgaaaggatggatccagcagtaagaatggttgcaggcgttgtaggtcatctgct

SEQ ID NO: 20860 - DNA, 60 bp, Artificial Sequence
  Description of Artificial Sequence: Synthetic probe
ccctggtgaaaggatggatccagcagtaagaatggttgcaggcgttgtaggtcatttgct

SEQ ID NO: 20861 - DNA, 60 bp, Artificial Sequence
  Description of Artificial Sequence: Synthetic probe
gctggggcgcatcagaacgctgacccagttgtgctagatgtgagctggatatcgctgtgg

SEQ ID NO: 20862 - DNA, 60 bp, Artificial Sequence
  Description of Artificial Sequence: Synthetic probe
agctttacagctaccggttaatccgcaagtagtgtgggatgtaccacgcagttctattgc

SEQ ID NO: 20863 - DNA, 60 bp, Artificial Sequence
  Description of Artificial Sequence: Synthetic probe
gcgagcgggcgtacgttaacggaggcgtatcgtgaatttctcaatctatcgatttcaagc

SEQ ID NO: 20864 - DNA, 60 bp, Artificial Sequence
  Description of Artificial Sequence: Synthetic probe
ggggcaagcgcaagaggcgagcgggcgtacgttaacggaggcgtatcgtgaatttctcaa

SEQ ID NO: 20865 - DNA, 60 bp, Artificial Sequence
  Description of Artificial Sequence: Synthetic probe
cgcggtgaggatgaaattaccagagttctcgtcaatcccgctagatggtttcgaactacc

SEQ ID NO: 20866 - DNA, 60 bp, Artificial Sequence
  Description of Artificial Sequence: Synthetic probe
aaaaagtgatctaagtggattgaagaagaagcgagcaatcatacacaccactctgctagt

SEQ ID NO: 20867 - DNA, 60 bp, Artificial Sequence
  Description of Artificial Sequence: Synthetic probe
atagcttcagagatcacacatggcacgggttgaggacggctatattaaataggactacat

SEQ ID NO: 20868 - DNA, 60 bp, Artificial Sequence
  Description of Artificial Sequence: Synthetic probe
atagcttcagagatcacacatggcacgggttgaggacggctatactaaacagaactacac

SEQ ID NO: 20869 - DNA, 60 bp, Artificial Sequence
  Description of Artificial Sequence: Synthetic probe
atagcttcagagatcacacatggcacgggttgaggacggctatactgaacagaactacac

SEQ ID NO: 20870 - DNA, 60 bp, Artificial Sequence
  Description of Artificial Sequence: Synthetic probe
tggttgggcgacgattgatgtcgagtatagagaacccgcaccctacgtacatgctcagcg

SEQ ID NO: 20871 - DNA, 51 bp, Artificial Sequence
  Description of Artificial Sequence: Synthetic probe
cgcgcgattcaagaaaaccacaaagaactgatgcatatcaagaatgagata

SEQ ID NO: 20872 - DNA, 60 bp, Artificial Sequence
  Description of Artificial Sequence: Synthetic probe
cgtgcgattcaagaaaaccacaaagaactgatgcatattaagaatgagatattaccgaga

SEQ ID NO: 20873 - DNA, 60 bp, Artificial Sequence
  Description of Artificial Sequence: Synthetic probe
cgttgtgcacgctgaaaggagagatcggagtcaacccttccgacctggtgatcaaacatt

SEQ ID NO: 20874 - DNA, 59 bp, Artificial Sequence
  Description of Artificial Sequence: Synthetic probe
ttgcactcgagatcttggataaagcgatgtcaaatacaacgggtgcaacgcagccacaa

SEQ ID NO: 20875 - DNA, 60 bp, Artificial Sequence
  Description of Artificial Sequence: Synthetic probe
gctgtccgcggctgggataaacgttggaccgatatctccagattatacccaacatatggc

SEQ ID NO: 20876 - DNA, 60 bp, Artificial Sequence
  Description of Artificial Sequence: Synthetic probe
ccgatataatggattaactttacggggagtgacgatgcgcccgacctcattggcgcagag

SEQ ID NO: 20877 - DNA, 59 bp, Artificial Sequence
  Description of Artificial Sequence: Synthetic probe
gcgaaagaggaggaagtggttcaggaacaatactcaatgctatgcaaagcagtagattc

SEQ ID NO: 20878 - DNA, 60 bp, Artificial Sequence
  Description of Artificial Sequence: Synthetic probe
gcgaggcgaaagaggaggaagtggttcaggaacaatactcaatgctatgcaaagcggtag

SEQ ID NO: 20879 - DNA, 57 bp, Artificial Sequence
  Description of Artificial Sequence: Synthetic probe
tggaacgatgagggatggcaggagggtatcttcatgctcggacgcgtactactgaga

SEQ ID NO: 20880 - DNA, 60 bp, Artificial Sequence
  Description of Artificial Sequence: Synthetic probe
tggaacgatgagggatggcaggagggtatcttcatgctcggacgcgtactactgagatgg

SEQ ID NO: 20881 - DNA, 60 bp, Artificial Sequence
  Description of Artificial Sequence: Synthetic probe
agcacaatcagatcaaacgtgaggttgagagacaaattaatacatgcccctacactggat

SEQ ID NO: 20882 - DNA, 60 bp, Artificial Sequence
  Description of Artificial Sequence: Synthetic probe
cgcgacttcaggcaaatatgggacagtttcgtgcggcgttacggcgtatcatggatgatg

SEQ ID NO: 20883 - DNA, 60 bp, Artificial Sequence
  Description of Artificial Sequence: Synthetic probe
ccgcgggatggaggttgcggaaccagaggtattaggcgtggaattcaagaatgtgctgcc

SEQ ID NO: 20884 - DNA, 60 bp, Artificial Sequence
  Description of Artificial Sequence: Synthetic probe
gtctccagaaagagttgggaatttcccgtgagggagtggctgagcagacggagagattga

SEQ ID NO: 20885 - DNA, 60 bp, Artificial Sequence
  Description of Artificial Sequence: Synthetic probe
acacatggcacgggttgaggacggctatactgaacagaactacactgccgaatatgctgc

SEQ ID NO: 20886 - DNA, 50 bp, Artificial Sequence
  Description of Artificial Sequence: Synthetic probe
cgtgctattgcacgcgccgcctatgtgtagtccactttgcacgggtgtgg

SEQ ID NO: 20887 - DNA, 51 bp, Artificial Sequence
  Description of Artificial Sequence: Synthetic probe
acgtgctattgcacgcgccgcctatgtgtagtccactttgcacgggtgtgg

SEQ ID NO: 20888 - DNA, 60 bp, Artificial Sequence
  Description of Artificial Sequence: Synthetic probe
ggggatgggaattgtgcaaccatacatgcggaatgattttgatcgaagtgaaatgcccga

SEQ ID NO: 20889 - DNA, 50 bp, Artificial Sequence
  Description of Artificial Sequence: Synthetic probe
aattacgaacgattggacccaagtttacatgaggggagggaacatgagac

SEQ ID NO: 20890 - DNA, 60 bp, Artificial Sequence
  Description of Artificial Sequence: Synthetic probe
cggacgtaaaatgttagatgttcaagaagagccaaaggatgagatggcactatccactag

SEQ ID NO: 20891 - DNA, 60 bp, Artificial Sequence
  Description of Artificial Sequence: Synthetic probe
tcggacgtaaaatgttagatgttcaagaagagccaaaggatgagatggcactatccacta

SEQ ID NO: 20892 - DNA, 60 bp, Artificial Sequence
  Description of Artificial Sequence: Synthetic probe
acgcgcattggagctctgcaaaatactctcggcgatcggacgtaaaatgttagatgttca

SEQ ID NO: 20893 - DNA, 60 bp, Artificial Sequence
  Description of Artificial Sequence: Synthetic probe
cgaaagagaaaacatgagcgagagttatcaggttgggacgcagagatggatacagctgcg

SEQ ID NO: 20894 - DNA, 60 bp, Artificial Sequence
  Description of Artificial Sequence: Synthetic probe
tcggaacgagatgcccgatttgccaggtgtgatgaggtcaaattatgatgttcgcgaact

SEQ ID NO: 20895 - DNA, 60 bp, Artificial Sequence
  Description of Artificial Sequence: Synthetic probe
tgacaagacgcgatttcctaacgcgcgatcgcagcatcgtggaagcgcgggtgaggagat

SEQ ID NO: 20896 - DNA, 50 bp, Artificial Sequence
  Description of Artificial Sequence: Synthetic probe
cactggagcggaggcattgattacaaccgcgattcacattcatcgctgga

SEQ ID NO: 20897 - DNA, 55 bp, Artificial Sequence
  Description of Artificial Sequence: Synthetic probe
tcaagcgctatgcctcaggcgagcggtggatttgatcgtatgattgttacgaaaa

SEQ ID NO: 20898 - DNA, 60 bp, Artificial Sequence
  Description of Artificial Sequence: Synthetic probe
tggaagctgggatcaactggaatctagatgagaaagatgaagaggatagagatgagcggg

SEQ ID NO: 20899 - DNA, 60 bp, Artificial Sequence
  Description of Artificial Sequence: Synthetic probe
ggtggaagctgggatcaactggaatctagatgagaaagatgaagaggatagaggtgaacg

SEQ ID NO: 20900 - DNA, 60 bp, Artificial Sequence
  Description of Artificial Sequence: Synthetic probe
aggtggaagctgggatcaactggaatctagatgagaaagatgaagaggatagaggtgaac

SEQ ID NO: 20901 - DNA, 55 bp, Artificial Sequence
  Description of Artificial Sequence: Synthetic probe
ttttgagaatggatgattttgcgaagcgttttaacaggtacgcctcgatggcgat

SEQ ID NO: 20902 - DNA, 60 bp, Artificial Sequence
  Description of Artificial Sequence: Synthetic probe
gagcgtgttgcttttgtctctaaggacatgagcttgatcatattgcggtcggcgtttagg

SEQ ID NO: 20903 - DNA, 60 bp, Artificial Sequence
  Description of Artificial Sequence: Synthetic probe
tgcgagcgtgttgcttttgtctctaaggacatgagcttaatcatattgccggtcggtgtt

SEQ ID NO: 20904 - DNA, 60 bp, Artificial Sequence
  Description of Artificial Sequence: Synthetic probe
ggtgtgagcgtgttgcttttgtctctaaggacatgagcttgatcatattgccggtcggcg

SEQ ID NO: 20905 - DNA, 60 bp, Artificial Sequence
  Description of Artificial Sequence: Synthetic probe
cgtgcgagcgtgttgcttttgtctctaaggacatgagcttaatcatattgccggtcggcg

SEQ ID NO: 20906 - DNA, 60 bp, Artificial Sequence
  Description of Artificial Sequence: Synthetic probe
cgtgtgagcgtgttgcttttgtctctaaggacatgagcttgatcatattgccggtcggcg

SEQ ID NO: 20907 - DNA, 60 bp, Artificial Sequence
  Description of Artificial Sequence: Synthetic probe
aggtgcgtgtgagcgtgttgcttttgtctctaaggacatgagcttgatcatattgccggt

SEQ ID NO: 20908 - DNA, 60 bp, Artificial Sequence
  Description of Artificial Sequence: Synthetic probe
gtgtaggtgcgtgcgagcgtgttgcttttgtctctaaggacatgagcttaatcatattgc

SEQ ID NO: 20909 - DNA, 60 bp, Artificial Sequence
  Description of Artificial Sequence: Synthetic probe
gtgtatgatgacgaactacagatgcatatactacgtgggccgctccattttcagagacga

SEQ ID NO: 20910 - DNA, 60 bp, Artificial Sequence
  Description of Artificial Sequence: Synthetic probe
tgtgtatgatgacgaactacagatgcatatactacgtgggccgctccattttcagagacg

SEQ ID NO: 20911 - DNA, 54 bp, Artificial Sequence
  Description of Artificial Sequence: Synthetic probe
cggggatggcgacagcagttgcgactgggagagctatcgagggagcatacaagc

SEQ ID NO: 20912 - DNA, 60 bp, Artificial Sequence
  Description of Artificial Sequence: Synthetic probe
aataggagcggggatggcgacagcggttgcgactgggagagctatcgagggagcatacaa

SEQ ID NO: 20913 - DNA, 60 bp, Artificial Sequence
  Description of Artificial Sequence: Synthetic probe
gaaggagtatagggataagatcgatgctctacgaagcgcaattgaggttgagagggatgg

SEQ ID NO: 20914 - DNA, 60 bp, Artificial Sequence
  Description of Artificial Sequence: Synthetic probe
tggtgaaggagtatagggataagatcgatgctctacggagcgcaattgaagttgagaggg

SEQ ID NO: 20915 - DNA, 60 bp, Artificial Sequence
  Description of Artificial Sequence: Synthetic probe
gcccaggggagcggggtatccaggcaaaactcaaagagttggaggatgagcagcgaaacg

SEQ ID NO: 20916 - DNA, 60 bp, Artificial Sequence
  Description of Artificial Sequence: Synthetic probe
gccctggggagcggggtatccaggcaaaactcaaagagctagaggatgagcaacgcaacg

SEQ ID NO: 20917 - DNA, 60 bp, Artificial Sequence
  Description of Artificial Sequence: Synthetic probe
tctaagcccaggggagcggggtatccaggcaaaactcaaagagttggaggatgagcagcg

SEQ ID NO: 20918 - DNA, 60 bp, Artificial Sequence
  Description of Artificial Sequence: Synthetic probe
gctaagccctggggagcggggtatccaggcaaaactcaaagagctagaggatgagcaacg

SEQ ID NO: 20919 - DNA, 60 bp, Artificial Sequence
  Description of Artificial Sequence: Synthetic probe
taccattaacctaagatcagtaggtagagtggcgccccaaggtttgcaccgcgtggagtg

SEQ ID NO: 20920 - DNA, 60 bp, Artificial Sequence
  Description of Artificial Sequence: Synthetic probe
ccattaacctaagatcagtaggtagagtggcgccccaaggtttgcaccgcatggagtggt

SEQ ID NO: 20921 - DNA, 60 bp, Artificial Sequence
  Description of Artificial Sequence: Synthetic probe
accattaacctaagatcagtaggtagagtggcgccccaaggtttgcaccgcatggagtgg

SEQ ID NO: 20922 - DNA, 60 bp, Artificial Sequence
  Description of Artificial Sequence: Synthetic probe
aacggaaataccgcagtggtttaagagtttaaatcctatgctcggagtgataaatctagg

SEQ ID NO: 20923 - DNA, 60 bp, Artificial Sequence
  Description of Artificial Sequence: Synthetic probe
aacggaaataccgcagtggtttaagagtttaaatccaatgctcggagtggtaaatctagg

SEQ ID NO: 20924 - DNA, 60 bp, Artificial Sequence
  Description of Artificial Sequence: Synthetic probe
aacggaaataccgcagtggtttaagagtttaaatcctatactcggagtggtaaatctagg

SEQ ID NO: 20925 - DNA, 60 bp, Artificial Sequence
  Description of Artificial Sequence: Synthetic probe
cggagctaactgggtgttcgccattcaagacggtgaaaattgaagaacatgtaggaaatg

SEQ ID NO: 20926 - DNA, 60 bp, Artificial Sequence
  Description of Artificial Sequence: Synthetic probe
cagagctaactgggtgttcgccattcaagacggtgaaaattgaggaacatgtgggaaatg

SEQ ID NO: 20927 - DNA, 60 bp, Artificial Sequence
  Description of Artificial Sequence: Synthetic probe
cagagctaactgggtgttcgccattcaagacggtgaaaattgaggaacatgtggggaatg

SEQ ID NO: 20928 - DNA, 60 bp, Artificial Sequence
  Description of Artificial Sequence: Synthetic probe
cagagctaactgggtgttcgccattcaagacggtgaaaattgaagaacatgtgggaaatg

SEQ ID NO: 20929 - DNA, 60 bp, Artificial Sequence
  Description of Artificial Sequence: Synthetic probe
tcagagctaactgggtgttcgccattcaagacggtgaaaattgaagaacatgtgggaaat

SEQ ID NO: 20930 - DNA, 60 bp, Artificial Sequence
  Description of Artificial Sequence: Synthetic probe
tcagagctaactgggtgttcgccattcaagacggtgaaaattgaggaacatgtgggaaat

SEQ ID NO: 20931 - DNA, 60 bp, Artificial Sequence
  Description of Artificial Sequence: Synthetic probe
tcagagctaactgggtgttcgccattcaagacggtgaaaattgaggaacatgtggggaat

SEQ ID NO: 20932 - DNA, 60 bp, Artificial Sequence
  Description of Artificial Sequence: Synthetic probe
tcggagctaactgggtgttcgccattcaagacggtgaaaattgaagaacatgtaggaaat

SEQ ID NO: 20933 - DNA, 60 bp, Artificial Sequence
  Description of Artificial Sequence: Synthetic probe
actggaatctagatgagaaagatgaagaggatagagatgagcgggaagatgaggagcagg

SEQ ID NO: 20934 - DNA, 60 bp, Artificial Sequence
  Description of Artificial Sequence: Synthetic probe
gaggcaacgtacttaaagagttggaggctggaattaactggaatttagatgaaggggata

SEQ ID NO: 20935 - DNA, 60 bp, Artificial Sequence
  Description of Artificial Sequence: Synthetic probe
agaggcaacgtacttaaagagttggaggctggaattaactggaatttagatgaaggggat

SEQ ID NO: 20936 - DNA, 60 bp, Artificial Sequence
  Description of Artificial Sequence: Synthetic probe
caggacctagcaggttggaaaagctacgtgaagcgagaggcaacgtacttaaagagttgg

SEQ ID NO: 20937 - DNA, 60 bp, Artificial Sequence
  Description of Artificial Sequence: Synthetic probe
ccaaagaaatgattccaggacctagcaggttggaaaagctacgtgaagcgagaggcaacg

SEQ ID NO: 20938 - DNA, 50 bp, Artificial Sequence
  Description of Artificial Sequence: Synthetic probe
atccggaacctaaagggtacgtgctgaatgttccaggacctggtgcatac

SEQ ID NO: 20939 - DNA, 60 bp, Artificial Sequence
  Description of Artificial Sequence: Synthetic probe
atccggaacctaaagggtacgtgctgaatgttccaggacctggtgcatacagaattcagg

SEQ ID NO: 20940 - DNA, 60 bp, Artificial Sequence
  Description of Artificial Sequence: Synthetic probe
tctttgttttggatgcagccgctaagacattatgcggggtaattgcgaagttaagttcgc

SEQ ID NO: 20941 - DNA, 60 bp, Artificial Sequence
  Description of Artificial Sequence: Synthetic probe
acatctttgttttggatgcagccgctaagacattatgcggggtaattgcgaagttaagtt

SEQ ID NO: 20942 - DNA, 60 bp, Artificial Sequence
  Description of Artificial Sequence: Synthetic probe
gttaaaaaaaccttgagtcatggagcaaaagcaacgtagattcactaaaaacatctttgt

SEQ ID NO: 20943 - DNA, 60 bp, Artificial Sequence
  Description of Artificial Sequence: Synthetic probe
gactgatcaagaacacgtaaatatatttaaagtaggtggttccgcaacagatgatgggag

SEQ ID NO: 20944 - DNA, 60 bp, Artificial Sequence
  Description of Artificial Sequence: Synthetic probe
gaaatttattaggactgatcaagaacacgtaaatatatttaaagtaggtggttccgcaac

SEQ ID NO: 20945 - DNA, 60 bp, Artificial Sequence
  Description of Artificial Sequence: Synthetic probe
ccaaaggatgagatggcgttatctactagatttcagttcaagttagacgagaaatttatt

SEQ ID NO: 20946 - DNA, 60 bp, Artificial Sequence
  Description of Artificial Sequence: Synthetic probe
gatgtaagttggatatggctttggttggcctttaatcggtcgtttgagccaacgcatcgg

SEQ ID NO: 20947 - DNA, 60 bp, Artificial Sequence
  Description of Artificial Sequence: Synthetic probe
gatgtaagttggatatcgctttggttcgcctttaatcggtcgtttgagccaacgcatcgt

SEQ ID NO: 20948 - DNA, 60 bp, Artificial Sequence
  Description of Artificial Sequence: Synthetic probe
agatgtaagttggatatcgctttggttcgcctttaatcggtcgtttgagccaacgcatcg

SEQ ID NO: 20949 - DNA, 60 bp, Artificial Sequence
  Description of Artificial Sequence: Synthetic probe
cagatagatatgataaagaaagaagtgatgaaaaaacaatcatataacgatgcggtgagg

SEQ ID NO: 20950 - DNA, 52 bp, Artificial Sequence
  Description of Artificial Sequence: Synthetic probe
tgcgtcacttgtaatgcgtgactgctaggtgaggggggcatgtacaacttac

SEQ ID NO: 20951 - DNA, 60 bp, Artificial Sequence
  Description of Artificial Sequence: Synthetic probe
cttgaattactgcgtcacttatgatgcgtgactgctaggtgaggggggcatgtacaactt

SEQ ID NO: 20952 - DNA, 60 bp, Artificial Sequence
  Description of Artificial Sequence: Synthetic probe
tgatccagcgtgggcgatgaattttgctgtttcgttaaaggagccgatacctgatcctcc

SEQ ID NO: 20953 - DNA, 60 bp, Artificial Sequence
  Description of Artificial Sequence: Synthetic probe
atgatccagcgtgggcgatgaattttgctgtttcgttgaaggagccgatacctgatcccc

SEQ ID NO: 20954 - DNA, 60 bp, Artificial Sequence
  Description of Artificial Sequence: Synthetic probe
cgcagagagaaggtgtcgaggaagaaaaaacgtctgaggagccggcacgcatcggaatta

SEQ ID NO: 20955 - DNA, 53 bp, Artificial Sequence
  Description of Artificial Sequence: Synthetic probe
gttactcaatgtatgacctgcgtgactgcaggtccgcgatctgttcaacttac

SEQ ID NO: 20956 - DNA, 60 bp, Artificial Sequence
  Description of Artificial Sequence: Synthetic probe
gaggggatagtaacgcatagggtttgtaagaaaagtttacttaaacatgtatgcgacatt

SEQ ID NO: 20957 - DNA, 60 bp, Artificial Sequence
  Description of Artificial Sequence: Synthetic probe
caaataaatgaggagggcggatttgatgtgtatacagaggggatagtaacgcatagggtt

SEQ ID NO: 20958 - DNA, 60 bp, Artificial Sequence
  Description of Artificial Sequence: Synthetic probe
gtatagtagtgattcaaataaatgaggagggcggatttgatgtgtatacagaggggatag

SEQ ID NO: 20959 - DNA, 60 bp, Artificial Sequence
  Description of Artificial Sequence: Synthetic probe
gctgtatacagaccgagtgaaggtgattccattggaggtgggctcatcgaacaatagaca

SEQ ID NO: 20960 - DNA, 60 bp, Artificial Sequence
  Description of Artificial Sequence: Synthetic probe
tatataaacataggcagtggtcgataccattattactgtatacagaccgagtgaaggtga

SEQ ID NO: 20961 - DNA, 60 bp, Artificial Sequence
  Description of Artificial Sequence: Synthetic probe
atgtacgatcggtatacgaggcgagatacattatatctaggataaggtcgtctaccggtg

SEQ ID NO: 20962 - DNA, 60 bp, Artificial Sequence
  Description of Artificial Sequence: Synthetic probe
tacattatctgatctgaatcaaacggtcgttttcatagtggattatttgcatgagaagcg

SEQ ID NO: 20963 - DNA, 65 bp, Artificial Sequence
  Description of Artificial Sequence: Synthetic probe
cgggcgatacattctggagaaatattctttacttcttatagatatattgaagtatcatactgagg

SEQ ID NO: 20964 - DNA, 60 bp, Artificial Sequence
  Description of Artificial Sequence: Synthetic probe
ggtgtaatcaagaaaccgacaagaccttgcgtaactttaaccgggcgatacattctggag

SEQ ID NO: 20965 - DNA, 60 bp, Artificial Sequence
  Description of Artificial Sequence: Synthetic probe
tcacggtttggtgtaatcaagaaaccgacaagaccttgcgtaactttaaccgggcgatac

SEQ ID NO: 20966 - DNA, 60 bp, Artificial Sequence
  Description of Artificial Sequence: Synthetic probe
gttcgctaaataggacacagactcaatcaacatttgacgcgaaggtgtcagagttgcccg

SEQ ID NO: 20967 - DNA, 60 bp, Artificial Sequence
  Description of Artificial Sequence: Synthetic probe
ggactaatgggtcgttcgctaaataggacacagactcaatcaacatttgacgcgaaggtg

SEQ ID NO: 20968 - DNA, 60 bp, Artificial Sequence
  Description of Artificial Sequence: Synthetic probe
aagtggatagttgcgccgatgttcaactctaaaatgagaattattgaaacggagattgca

SEQ ID NO: 20969 - DNA, 60 bp, Artificial Sequence
  Description of Artificial Sequence: Synthetic probe
gttacttcaggaaaaaggcaatgttctcacaattgacttcgaaaaggatacgaagctgaa

SEQ ID NO: 20970 - DNA, 60 bp, Artificial Sequence
  Description of Artificial Sequence: Synthetic probe
cggagaagtatatatttagtaagataaatctatttgattacgaagctggtccatcgagca

SEQ ID NO: 20971 - DNA, 60 bp, Artificial Sequence
  Description of Artificial Sequence: Synthetic probe
cggcggagacaaaattaggcgatgtttactttactctacgatcttggtatgactggagtg

SEQ ID NO: 20972 - DNA, 60 bp, Artificial Sequence
  Description of Artificial Sequence: Synthetic probe
attgcggcggagacaaaattaggcgatgtttactttactctacgatcttggtatgactgg

SEQ ID NO: 20973 - DNA, 60 bp, Artificial Sequence
  Description of Artificial Sequence: Synthetic probe
atttgagcccaaatcgcataggaaggatgaggataggttctacgttttgttagctatcgc

SEQ ID NO: 20974 - DNA, 60 bp, Artificial Sequence
  Description of Artificial Sequence: Synthetic probe
ctgagagaaataagatatttgagcacaaatcgcataggaaggatgaggataggttctacg

SEQ ID NO: 20975 - DNA, 60 bp, Artificial Sequence
  Description of Artificial Sequence: Synthetic probe
cgagctctcgatgagaagttccgtcttaacgattctaagagaaataagatatttgagccc

SEQ ID NO: 20976 - DNA, 60 bp, Artificial Sequence
  Description of Artificial Sequence: Synthetic probe
cttatctttgcgatttcagcgagctctcgatgagaagttccgtcttaacgattctgagag

SEQ ID NO: 20977 - DNA, 60 bp, Artificial Sequence
  Description of Artificial Sequence: Synthetic probe
gcggaaccggttgatgaagatagcttatctttgcggtttcagcgagctctcgatgagaag

SEQ ID NO: 20978 - DNA, 60 bp, Artificial Sequence
  Description of Artificial Sequence: Synthetic probe
ggcagaattatgttggatcaagaagcggaaccggttgatgaagatagcttatctttgcga

SEQ ID NO: 20979 - DNA, 60 bp, Artificial Sequence
  Description of Artificial Sequence: Synthetic probe
agatagtatggatcaacagccgcttaagatatcgattgacgaggaacatagccgggttgt

SEQ ID NO: 20980 - DNA, 60 bp, Artificial Sequence
  Description of Artificial Sequence: Synthetic probe
ccatactgacacaaactgggttcagtggatgattaaagatagtatggatcaacagccgct

SEQ ID NO: 20981 - DNA, 60 bp, Artificial Sequence
  Description of Artificial Sequence: Synthetic probe
taagagtaacagcttccatactgacacaaactgggttcagtggatgattaaagatagtat

SEQ ID NO: 20982 - DNA, 60 bp, Artificial Sequence
  Description of Artificial Sequence: Synthetic probe
gacattagcttgaagggatatgacatacggaaatcagttattgaagcgaataagagtaac

SEQ ID NO: 20983 - DNA, 60 bp, Artificial Sequence
  Description of Artificial Sequence: Synthetic probe
ccaagtcaaggtggacgtcatgatgtttccaagattcctgagatgtttgcttacgatatc

SEQ ID NO: 20984 - DNA, 60 bp, Artificial Sequence
  Description of Artificial Sequence: Synthetic probe
ccggcgtgagatatccaagtcaaggtggacgtcatgatgtttccaagattcctgagatgt

SEQ ID NO: 20985 - DNA, 60 bp, Artificial Sequence
  Description of Artificial Sequence: Synthetic probe
cgagctgcgcaggccgtaactgctgtggtgtgtggcccagacatgatccaagtgtcattg

SEQ ID NO: 20986 - DNA, 60 bp, Artificial Sequence
  Description of Artificial Sequence: Synthetic probe
caccctttcaagtgatatgagtgtggctttcaagataaatgggaccaaaacagaagtgcc

SEQ ID NO: 20987 - DNA, 60 bp, Artificial Sequence
  Description of Artificial Sequence: Synthetic probe
gtggaaaagacgcaaacgcatgcaaaacagggttgttacgtaccgcaggatcgtatgctg

SEQ ID NO: 20988 - DNA, 60 bp, Artificial Sequence
  Description of Artificial Sequence: Synthetic probe
gcagctgtggttgcgctgttgacatcagtttgcaccctttcaagcgatatgagtgtggcc

SEQ ID NO: 20989 - DNA, 60 bp, Artificial Sequence
  Description of Artificial Sequence: Synthetic probe
agttctctagttggcaaccaccaaacatggagcgctttttgagaaaatacaacatcagtg

SEQ ID NO: 20990 - DNA, 60 bp, Artificial Sequence
  Description of Artificial Sequence: Synthetic probe
cgtatgattgttacgaagaagcttaagtggcggaatgtgccactgtattgctttgatgag

SEQ ID NO: 20991 - DNA, 60 bp, Artificial Sequence
  Description of Artificial Sequence: Synthetic probe
tgagtcatggagcaaaagcaacgtaaatttaccaaaaacatttttgtcttggatgtaacc

SEQ ID NO: 20992 - DNA, 60 bp, Artificial Sequence
  Description of Artificial Sequence: Synthetic probe
ccttgagtcatggagcaaaagcaacgtaaatttaccaaaaacatttttgtcttggatgta

SEQ ID NO: 20993 - DNA, 60 bp, Artificial Sequence
  Description of Artificial Sequence: Synthetic probe
ctcaaccaccaagatatgctccgagcgcgccaatgccatcgtcgatgccaacagttgcac

SEQ ID NO: 20994 - DNA, 60 bp, Artificial Sequence
  Description of Artificial Sequence: Synthetic probe
cgcatcgtacgcagaagcgtttcgtgatgacgtgaggttgagacagattaaacgacatgt

SEQ ID NO: 20995 - DNA, 60 bp, Artificial Sequence
  Description of Artificial Sequence: Synthetic probe
ggtgctggcactgcagttgcccgtaaatcctcaagtagtctgggacgttcctcggagttc

SEQ ID NO: 20996 - DNA, 60 bp, Artificial Sequence
  Description of Artificial Sequence: Synthetic probe
gcgggatggaagttgcggagccggaggtattgggtgtggaattcaagaatgtgctgcctg

SEQ ID NO: 20997 - DNA, 60 bp, Artificial Sequence
  Description of Artificial Sequence: Synthetic probe
ccaatagcgccggaatgtttagatccaaacgtcatagttcataatgttatggtagattca

SEQ ID NO: 20998 - DNA, 60 bp, Artificial Sequence
  Description of Artificial Sequence: Synthetic probe
tgatccaatagcgccggaatgtttagatccaaacgtcatagttcataatgttatggtaga

SEQ ID NO: 20999 - DNA, 60 bp, Artificial Sequence
  Description of Artificial Sequence: Synthetic probe
gtgacgcactaagaaactacgccttcaagatggctatcgaatttcacggatcagaggcag

SEQ ID NO: 21000 - DNA, 60 bp, Artificial Sequence
  Description of Artificial Sequence: Synthetic probe
caaaggatttggtgacgcactaagaaactacgccttcaagatggctatcgaatttcacgg

SEQ ID NO: 21001 - DNA, 60 bp, Artificial Sequence
  Description of Artificial Sequence: Synthetic probe
gtttgcgtcgtgcagggtggttgacctcgcggcgtaaattcccactgctgtataacgggg

SEQ ID NO: 21002 - DNA, 60 bp, Artificial Sequence
  Description of Artificial Sequence: Synthetic probe
cgcggatgaatgatcatgagtgggagacgaccaggtttgcggaggatagattgggtgagg

SEQ ID NO: 21003 - DNA, 60 bp, Artificial Sequence
  Description of Artificial Sequence: Synthetic probe
tcataaatactaggctccaatcccatattgcaccgattagtcaaataaaacagatccgct

SEQ ID NO: 21004 - DNA, 60 bp, Artificial Sequence
  Description of Artificial Sequence: Synthetic probe
aaaaggaattgtctatttaatggaatgtgtgtcaagcagcattttgagagagcgatgatc

SEQ ID NO: 21005 - DNA, 60 bp, Artificial Sequence
  Description of Artificial Sequence: Synthetic probe
agcttatacaagtacagggggtgatgtgaaaacagagtttctacatttgatcgatcacct

SEQ ID NO: 21006 - DNA, 53 bp, Artificial Sequence
  Description of Artificial Sequence: Synthetic probe
aaaacgtctgaggagccggcgtgcattggaattacaatagaaggggtcatgag

SEQ ID NO: 21007 - DNA, 57 bp, Artificial Sequence
  Description of Artificial Sequence: Synthetic probe
agaaaaaacgtctgaggagccggcgtgcattggaattacaatagaaggggtcatgag

SEQ ID NO: 21008 - DNA, 58 bp, Artificial Sequence
  Description of Artificial Sequence: Synthetic probe
caaaaggacctggagaacgcgcgaacgagaatgctgacagaggagatggaaaggttgg

SEQ ID NO: 21009 - DNA, 60 bp, Artificial Sequence
  Description of Artificial Sequence: Synthetic probe
actaaatagaacaaccttaccaaatatgcttccaccgatttttccaccaaatgatagaga

SEQ ID NO: 21010 - DNA, 60 bp, Artificial Sequence
  Description of Artificial Sequence: Synthetic probe
ggattaagaacggcaatactgaatagaacaaccttaccaaatatgcttccaccgattttt

SEQ ID NO: 21011 - DNA, 59 bp, Artificial Sequence
  Description of Artificial Sequence: Synthetic probe
ggattaagaacggcaatactgaatagaacaaccttaccaaatatgcttccaccgatttt

SEQ ID NO: 21012 - DNA, 60 bp, Artificial Sequence
  Description of Artificial Sequence: Synthetic probe
tcgtatgattgtcacgaagaagcttaaatggcagaatgtgccattatactgttttgatga

SEQ ID NO: 21013 - DNA, 60 bp, Artificial Sequence
  Description of Artificial Sequence: Synthetic probe
tcaagcgctatgcctccagcgagcggtggatttgatcgtatgattgtcacgaagaagctt

SEQ ID NO: 21014 - DNA, 60 bp, Artificial Sequence
  Description of Artificial Sequence: Synthetic probe
cggttcatgagtctatcaagcgctatgcctccagcgagcggtggatttgatcgtatgatt

SEQ ID NO: 21015 - DNA, 60 bp, Artificial Sequence
  Description of Artificial Sequence: Synthetic probe
gaggctaaagagatgattccgggaccgagcagattgaagaagctgcgtgaagcgagaagc

SEQ ID NO: 21016 - DNA, 60 bp, Artificial Sequence
  Description of Artificial Sequence: Synthetic probe
gaagaggctaaagagatgattccgggaccgagcagattgaagaagctgcgtgaagcgaga

SEQ ID NO: 21017 - DNA, 60 bp, Artificial Sequence
  Description of Artificial Sequence: Synthetic probe
gggcaggatatcatcagcttgatgttgacaccacatggggttgaagcgacaacggaaagg

SEQ ID NO: 21018 - DNA, 60 bp, Artificial Sequence
  Description of Artificial Sequence: Synthetic probe
agaattcaggatgggcaggatatcatcagcttgatgttgacaccacatggggttgaagcg

SEQ ID NO: 21019 - DNA, 60 bp, Artificial Sequence
  Description of Artificial Sequence: Synthetic probe
catagggaaggcggcggaaaggttcgcggagagtgaaattggatctgcggcgattgacgg

SEQ ID NO: 21020 - DNA, 60 bp, Artificial Sequence
  Description of Artificial Sequence: Synthetic probe
tatgcagagaaggttcatttcgctgggttcgcggcgcctgcgtgtgagagcggggaagtt

SEQ ID NO: 21021 - DNA, 55 bp, Artificial Sequence
  Description of Artificial Sequence: Synthetic probe
gcacatagacagtggagtataccggtgctgctgtacgcgcacgatatccgaatta

SEQ ID NO: 21022 - DNA, 60 bp, Artificial Sequence
  Description of Artificial Sequence: Synthetic probe
gattctgaagtaacgtttgaacacccaacagtcgatcccaacatcgatattgagacgtgg

SEQ ID NO: 21023 - DNA, 60 bp, Artificial Sequence
  Description of Artificial Sequence: Synthetic probe
ggccgcgctctctctaagcaacagaatatgtcgtcaatgactgataaactctctaagcag

SEQ ID NO: 21024 - DNA, 60 bp, Artificial Sequence
  Description of Artificial Sequence: Synthetic probe
aggacgcgcacatcggcacaggctcagctctaagtttgccggattactataacaaatgga

SEQ ID NO: 21025 - DNA, 60 bp, Artificial Sequence
  Description of Artificial Sequence: Synthetic probe
gtggagcaatccgtatccctgcctacgtggagcattaattgccgctgaagtccaattagg

SEQ ID NO: 21026 - DNA, 60 bp, Artificial Sequence
  Description of Artificial Sequence: Synthetic probe
tggtggagcaatccgtatccctgcctacgtggagcattaattgccgctgaagtccaatta

SEQ ID NO: 21027 - DNA, 60 bp, Artificial Sequence
  Description of Artificial Sequence: Synthetic probe
gattctagattggtctgcgcaaaacaaggaacaaaaactacgcgatctaaagaggtctgc

SEQ ID NO: 21028 - DNA, 51 bp, Artificial Sequence
  Description of Artificial Sequence: Synthetic probe
aaaattacgtgatttaaagaggtctgcagcggaggtaatcgaatggaagga

SEQ ID NO: 21029 - DNA, 60 bp, Artificial Sequence
  Description of Artificial Sequence: Synthetic probe
ctggtctgcgcaaagcaaggaacaaaaattacgtgatttaaagaggtctgcagcggaggt

SEQ ID NO: 21030 - DNA, 60 bp, Artificial Sequence
  Description of Artificial Sequence: Synthetic probe
gcatttatgaagtaatgaagaagtcggtgatcgctacggcctgggtagttcgcgctcctc

SEQ ID NO: 21031 - DNA, 60 bp, Artificial Sequence
  Description of Artificial Sequence: Synthetic probe
ggattggaaccaagcatttatgaagtaatgaagaagtcggtgatcgctacggcctgggta

SEQ ID NO: 21032 - DNA, 56 bp, Artificial Sequence
  Description of Artificial Sequence: Synthetic probe
gttttccagtgcattgattaaacataggataccaaattcaagagacgagtatcact

SEQ ID NO: 21033 - DNA, 60 bp, Artificial Sequence
  Description of Artificial Sequence: Synthetic probe
cgcagatggatgatgatgaatgggaatcgaccaggttcgcagaggataggttgggtgaag

SEQ ID NO: 21034 - DNA, 60 bp, Artificial Sequence
  Description of Artificial Sequence: Synthetic probe
tgtcctcagatcgatcgcagatggatgatgatgaatgggaatcgaccagattcgcagagg

SEQ ID NO: 21035 - DNA, 51 bp, Artificial Sequence
  Description of Artificial Sequence: Synthetic probe
agaaattggaactagatttgacgatgagccaactgatgaaaagttagtatc

SEQ ID NO: 21036 - DNA, 60 bp, Artificial Sequence
  Description of Artificial Sequence: Synthetic probe
gcaacagatgtatatgcatacggagatgtatcaaagtggacgatacggcaattacgaggt

SEQ ID NO: 21037 - DNA, 60 bp, Artificial Sequence
  Description of Artificial Sequence: Synthetic probe
cgcgttgaaacttctgaagaaagggatcgcaggcgacgaattcactatgtcgttgaacgt

SEQ ID NO: 21038 - DNA, 60 bp, Artificial Sequence
  Description of Artificial Sequence: Synthetic probe
gaaggtgagttggacggcgctccctatatgttcccagaccagaacttatctccgcagttc

SEQ ID NO: 21039 - DNA, 60 bp, Artificial Sequence
  Description of Artificial Sequence: Synthetic probe
gcttccacttggagagttttcacccggacgtatttcgagaaccatgatgcacagtgctct

SEQ ID NO: 21040 - DNA, 60 bp, Artificial Sequence
  Description of Artificial Sequence: Synthetic probe
gcgccgataagaaggattgtgcatgatattccaccgtgttggaacgagactcagggagac

SEQ ID NO: 21041 - DNA, 60 bp, Artificial Sequence
  Description of Artificial Sequence: Synthetic probe
gtggagaagacccaaacgcatgcaaagcagggttgttatgtaccgcaggatcgtatgatg

SEQ ID NO: 21042 - DNA, 60 bp, Artificial Sequence
  Description of Artificial Sequence: Synthetic probe
ggaagttgggagggagcagccaggggttctgactttcttatcggagcaatacgtggggga

SEQ ID NO: 21043 - DNA, 60 bp, Artificial Sequence
  Description of Artificial Sequence: Synthetic probe
ggagaggggagggtagcgaatacactatggaatggaaagcggagactgttcaaaactaca

SEQ ID NO: 21044 - DNA, 60 bp, Artificial Sequence
  Description of Artificial Sequence: Synthetic probe
gagcgtagagaggagatcgttaaacctgaagacttatacacatcaatgttgcgattagcg

SEQ ID NO: 21045 - DNA, 59 bp, Artificial Sequence
  Description of Artificial Sequence: Synthetic probe
ctcggcgttggaattcggtgatatgaaagttgatccggttggactattgcgtgaatttt

SEQ ID NO: 21046 - DNA, 60 bp, Artificial Sequence
  Description of Artificial Sequence: Synthetic probe
cgagtggtcgaacgcttttatccagggatagcatttaatataaatgaaggagcatgctat

SEQ ID NO: 21047 - DNA, 60 bp, Artificial Sequence
  Description of Artificial Sequence: Synthetic probe
gagcagcttgaagcgattcgaaccagatgggcaactggcagatacgacccagctcatatc

SEQ ID NO: 21048 - DNA, 60 bp, Artificial Sequence
  Description of Artificial Sequence: Synthetic probe
gggatacgggacgcactcaaatatatgccaacacgaaatgatggggtggtcttgccaagg

SEQ ID NO: 21049 - DNA, 60 bp, Artificial Sequence
  Description of Artificial Sequence: Synthetic probe
gtattgcgattaacaggtataatggattaacgctccgtggagtcacaatgcgcccgacat

SEQ ID NO: 21050 - DNA, 60 bp, Artificial Sequence
  Description of Artificial Sequence: Synthetic probe
aagacagattaaacgtcatgttaatgaacagatccttccaaagttaaagagtgatttggg

SEQ ID NO: 21051 - DNA, 60 bp, Artificial Sequence
  Description of Artificial Sequence: Synthetic probe
tgatgatgtgagactaagacagattaaacgtcatgttaatgaacagatccttccaaagtt

SEQ ID NO: 21052 - DNA, 60 bp, Artificial Sequence
  Description of Artificial Sequence: Synthetic probe
gggttatgcgggtggtgtgtcggttgcaagaaatatgtatcttgtttaaacgtctctggg

SEQ ID NO: 21053 - DNA, 60 bp, Artificial Sequence
  Description of Artificial Sequence: Synthetic probe
gtgggttatgcgggtggtgtgtcggttgcaagaaatatgtatcttgtttaaacgtctctg

SEQ ID NO: 21054 - DNA, 60 bp, Artificial Sequence
  Description of Artificial Sequence: Synthetic probe
gtgtgggttatgcgggtggtgtgtcggttgcaagaaatgtgtgtcttgtttaaacgtctc

SEQ ID NO: 21055 - DNA, 60 bp, Artificial Sequence
  Description of Artificial Sequence: Synthetic probe
ggtgtgggttatgcgggtggtgtgtcggttgcaagaaatgtgtgtcttgtttaaacgtct

SEQ ID NO: 21056 - DNA, 60 bp, Artificial Sequence
  Description of Artificial Sequence: Synthetic probe
gggtgtgggttatgcgggtggtgtgtcggttgcaagaaatgtgtgtcttgtttaaacgtc

SEQ ID NO: 21057 - DNA, 60 bp, Artificial Sequence
  Description of Artificial Sequence: Synthetic probe
cgggtgtgggttatgcgggtggtgtgtcggttgcaagaaatgtgtgtcttgtttaaacgt

SEQ ID NO: 21058 - DNA, 60 bp, Artificial Sequence
  Description of Artificial Sequence: Synthetic probe
gtccactttgcacgggtgtgggttatgcgggtggtgtgtcggttgcaagaaatatgtgtc

SEQ ID NO: 21059 - DNA, 60 bp, Artificial Sequence
  Description of Artificial Sequence: Synthetic probe
atagtccactttgcacgggtgtgggttatgcgggtggtgtgtcggttgcaagaaatatgt

SEQ ID NO: 21060 - DNA, 60 bp, Artificial Sequence
  Description of Artificial Sequence: Synthetic probe
gggatcacacatggcatggcctaaggacggcgatattaaacagaaccacactgccaaaca

SEQ ID NO: 21061 - DNA, 60 bp, Artificial Sequence
  Description of Artificial Sequence: Synthetic probe
taagtgacacctggatcatatccggaccgcatactactgcagttactgcttgagcggcgc

SEQ ID NO: 21062 - DNA, 60 bp, Artificial Sequence
  Description of Artificial Sequence: Synthetic probe
cgcgccgctcaagcagtaactgcagtagtatgcggtccggatatgatccaggtgtcactt

SEQ ID NO: 21063 - DNA, 60 bp, Artificial Sequence
  Description of Artificial Sequence: Synthetic probe
aagtgacacctggatcatatccggaccgcatactactgcagttactgcttgagcggcgcg

SEQ ID NO: 21064 - DNA, 60 bp, Artificial Sequence
  Description of Artificial Sequence: Synthetic probe
tcatttctttgtgctaacgaagtcgggcgcatcgtcacacctcgtagagtcagtccattg

SEQ ID NO: 21065 - DNA, 60 bp, Artificial Sequence
  Description of Artificial Sequence: Synthetic probe
gtgctaacgaagtcgggcgcatcgtcacacctcgtagagtcagtccattgtacctattga

SEQ ID NO: 21066 - DNA, 60 bp, Artificial Sequence
  Description of Artificial Sequence: Synthetic probe
ggggatagctatcaataggtacaatggactgactctacgaggtgtgacgatgcgcccgac

SEQ ID NO: 21067 - DNA, 60 bp, Artificial Sequence
  Description of Artificial Sequence: Synthetic probe
tgtgatggaaattctggggatagctatcaataggtacaatggactgactctacgaggtgt

SEQ ID NO: 21068 - DNA, 50 bp, Artificial Sequence
  Description of Artificial Sequence: Synthetic probe
tcggttgtgggatatgtgacccattcaaacgtctcttagattacacttac

SEQ ID NO: 21069 - DNA, 60 bp, Artificial Sequence
  Description of Artificial Sequence: Synthetic probe
gcggaagcgtttcgtgatgatgtaagattgagacagattaaacgccatgtgaacgagcag

SEQ ID NO: 21070 - DNA, 60 bp, Artificial Sequence
  Description of Artificial Sequence: Synthetic probe
ggcggtaagcgttctatcgaagaatcgtgtcatacaagacaatcataaggaactcatgca

SEQ ID NO: 21071 - DNA, 60 bp, Artificial Sequence
  Description of Artificial Sequence: Synthetic probe
aatacgttggcggtaagcgttctatcgaagaatcgtgtcatacaagacaatcataaggaa

SEQ ID NO: 21072 - DNA, 58 bp, Artificial Sequence
  Description of Artificial Sequence: Synthetic probe
gggtggaatgaggaggagttcaagatgtacaaattacttcagagtgacggtaatgttc

SEQ ID NO: 21073 - DNA, 60 bp, Artificial Sequence
  Description of Artificial Sequence: Synthetic probe
gaggcaaagtatacggagatggtcggggagataatagatggtgggtggaatgaggaggag

SEQ ID NO: 21074 - DNA, 60 bp, Artificial Sequence
  Description of Artificial Sequence: Synthetic probe
aatttgatgaggcaaagtatacggagatggtcggggagataatagatggtgggtggaatg

SEQ ID NO: 21075 - DNA, 60 bp, Artificial Sequence
  Description of Artificial Sequence: Synthetic probe
cgcttgtgacttgtacccagacagcgatgaggacgtgatagttacaaaatttgatgaggc

SEQ ID NO: 21076 - DNA, 60 bp, Artificial Sequence
  Description of Artificial Sequence: Synthetic probe
gggagtaccagttgtataagagtgaatggaaggttacccttgagcgaggaaacgcttgtg

SEQ ID NO: 21077 - DNA, 60 bp, Artificial Sequence
  Description of Artificial Sequence: Synthetic probe
gagtcaacctttttgattatgatgcgggaccgtcaagtaaaataatacattgggagtacc

SEQ ID NO: 21078 - DNA, 60 bp, Artificial Sequence
  Description of Artificial Sequence: Synthetic probe
caacgcgcctcgtgaaagagaacgtgaaacagagaagtatatatttagtagagtcaacct

SEQ ID NO: 21079 - DNA, 60 bp, Artificial Sequence
  Description of Artificial Sequence: Synthetic probe
attacgttcatggtatgactggagcgttcgtagtaacaacgcgcctcgtgaaagagaacg

SEQ ID NO: 21080 - DNA, 60 bp, Artificial Sequence
  Description of Artificial Sequence: Synthetic probe
catacccatgtctaagaggagcattaattgcggcggagtcaaagctgggagatgtttatt

SEQ ID NO: 21081 - DNA, 56 bp, Artificial Sequence
  Description of Artificial Sequence: Synthetic probe
agtctttcacttagatttcagcaggcgttagatgaaaaatttcgtttgaatgactc

SEQ ID NO: 21082 - DNA, 60 bp, Artificial Sequence
  Description of Artificial Sequence: Synthetic probe
tgttggatcaagaagcggaacccgtagatgaaggtagtctttcacttagatttcagcagg

SEQ ID NO: 21083 - DNA, 60 bp, Artificial Sequence
  Description of Artificial Sequence: Synthetic probe
cctgtacatgttaattcgcaggagttatgtcggatattatcacgcatcggaagaattatg

SEQ ID NO: 21084 - DNA, 60 bp, Artificial Sequence
  Description of Artificial Sequence: Synthetic probe
agcgaaatggatcaactcgaagcgattaggtccagatgggcatcgggtagatatgatcct

SEQ ID NO: 21085 - DNA, 60 bp, Artificial Sequence
  Description of Artificial Sequence: Synthetic probe
cttactgtacagggtaacgtcccgagggctattcagagcgaaatggatcaactcgaagcg

SEQ ID NO: 21086 - DNA, 60 bp, Artificial Sequence
  Description of Artificial Sequence: Synthetic probe
aacgactagttcgacttactgtacagggtaacgtcccgagggctattcagagcgaaatgg

SEQ ID NO: 21087 - DNA, 60 bp, Artificial Sequence
  Description of Artificial Sequence: Synthetic probe
gcgggggcatagggtgcaaatgggggatgaagcgtatgtaaagttaattcaacgactagt

SEQ ID NO: 21088 - DNA, 60 bp, Artificial Sequence
  Description of Artificial Sequence: Synthetic probe
aagccaacataccaattaatagttcattcagagagagcgtcaacgtcagagaattttgaa

SEQ ID NO: 21089 - DNA, 60 bp, Artificial Sequence
  Description of Artificial Sequence: Synthetic probe
gagaatggatttatttcatgcagcgcaagagattgcgtatgtgatcaagccaacatacca

SEQ ID NO: 21090 - DNA, 60 bp, Artificial Sequence
  Description of Artificial Sequence: Synthetic probe
caaactaaggcatgtctgcatacaaaaggtcatatttgccatcatctaatgagaatggat

SEQ ID NO: 21091 - DNA, 60 bp, Artificial Sequence
  Description of Artificial Sequence: Synthetic probe
cgcgaagaaggctgatacattatcttatcatgttgaggcggttgaggatcaaactaaggc

SEQ ID NO: 21092 - DNA, 60 bp, Artificial Sequence
  Description of Artificial Sequence: Synthetic probe
atgaggaccatagccgtgtagttcattcgctttttaattgtcaggtaaagattgacgcga

SEQ ID NO: 21093 - DNA, 60 bp, Artificial Sequence
  Description of Artificial Sequence: Synthetic probe
cttccacacggatgtagattgggtacagtggatgattaaggatagcaccgaccagcaacc

SEQ ID NO: 21094 - DNA, 60 bp, Artificial Sequence
  Description of Artificial Sequence: Synthetic probe
ggggtatgatatcagaaagtctgttatagaggcctcgaagcataacagcttccacacgga

SEQ ID NO: 21095 - DNA, 60 bp, Artificial Sequence
  Description of Artificial Sequence: Synthetic probe
cgacatgacgtatcgaagattccagagatgtacgcatttgatatcaaagatgaggggatt

SEQ ID NO: 21096 - DNA, 60 bp, Artificial Sequence
  Description of Artificial Sequence: Synthetic probe
gttatgagttcttgatcaacataggagataaaattccaagccaagatggccgacatgacg

SEQ ID NO: 21097 - DNA, 60 bp, Artificial Sequence
  Description of Artificial Sequence: Synthetic probe
ttatgggcgtggctatcccgagcatttgttgaaaggttatgagttcttgatcaacatagg

SEQ ID NO: 21098 - DNA, 60 bp, Artificial Sequence
  Description of Artificial Sequence: Synthetic probe
attcgctattccaatttatgggcgtggctatcccgagcatttgttgaaaggttatgagtt

SEQ ID NO: 21099 - DNA, 50 bp, Artificial Sequence
  Description of Artificial Sequence: Synthetic probe
cgccgcggcttcaagttcaaagcgtggcgccaagggaagaatcacgctgg

SEQ ID NO: 21100 - DNA, 57 bp, Artificial Sequence
  Description of Artificial Sequence: Synthetic probe
gaatcagcgccgcggcttcaagttcaaagcgtggcgccaagggaagaatcacgctgg

SEQ ID NO: 21101 - DNA, 60 bp, Artificial Sequence
  Description of Artificial Sequence: Synthetic probe
cgagaatcagtgccacggcttcaagttcaaagcgtggcgccaagggaagaatcacgctgg

SEQ ID NO: 21102 - DNA, 60 bp, Artificial Sequence
  Description of Artificial Sequence: Synthetic probe
cagacagaagatcgatgcgcttaaagatgcgatcgagattgagcgagatggaatgcagga

SEQ ID NO: 21103 - DNA, 57 bp, Artificial Sequence
  Description of Artificial Sequence: Synthetic probe
tacgtcgtgcagggtggttgatctcgcggcgtacattcccactgctgtataacgggg

SEQ ID NO: 21104 - DNA, 60 bp, Artificial Sequence
  Description of Artificial Sequence: Synthetic probe
tacgtcgtgcagggtggttgatctcgcggcgtacattcccactgctgtataacgggggag

SEQ ID NO: 21105 - DNA, 60 bp, Artificial Sequence
  Description of Artificial Sequence: Synthetic probe
agaaggctgcattcgcatcgtacgcgggagtagctcgtgatgatgtgagattgagacaga

SEQ ID NO: 21106 - DNA, 60 bp, Artificial Sequence
  Description of Artificial Sequence: Synthetic probe
gcgttgtaggtcatctgcttttcacggcgggaggaagatttactaacctaactcaaaata

SEQ ID NO: 21107 - DNA, 60 bp, Artificial Sequence
  Description of Artificial Sequence: Synthetic probe
ggatccagcagtaagaatggttgcaggcgttgtaggccatctgcttttcacggcgggagg

SEQ ID NO: 21108 - DNA, 60 bp, Artificial Sequence
  Description of Artificial Sequence: Synthetic probe
gacgaaggcgcagcgcagcgcgttgctcaggttgttctgcttcgtgtgttacggatatgc

SEQ ID NO: 21109 - DNA, 60 bp, Artificial Sequence
  Description of Artificial Sequence: Synthetic probe
tttcatgcttgggcgcgtactactgagatgggaactgacgaaggcgcagcgcagcgcgtt

SEQ ID NO: 21110 - DNA, 60 bp, Artificial Sequence
  Description of Artificial Sequence: Synthetic probe
tggcaggaaggtattttcatgcttgggcgcgtactactgagatgggaactgacgaaggcg

SEQ ID NO: 21111 - DNA, 60 bp, Artificial Sequence
  Description of Artificial Sequence: Synthetic probe
ttacactggagcggaagctttgattacaaccgcagtccacattcaccgctggattagagg

SEQ ID NO: 21112 - DNA, 60 bp, Artificial Sequence
  Description of Artificial Sequence: Synthetic probe
ttacactggagcggaagctttgattacaaccgcaatccacattcaccgctggattagagg

SEQ ID NO: 21113 - DNA, 60 bp, Artificial Sequence
  Description of Artificial Sequence: Synthetic probe
cctgtggtgtaattgacgtgcgcgcatcagaactaacggggtgctcaccattcaagacgg

SEQ ID NO: 21114 - DNA, 60 bp, Artificial Sequence
  Description of Artificial Sequence: Synthetic probe
aacctgtggtgtaattgacgtgcgcgcatcagaactaacggggtgctcaccattcaagac

SEQ ID NO: 21115 - DNA, 60 bp, Artificial Sequence
  Description of Artificial Sequence: Synthetic probe
caactgtgctacctgaagcactcgaagcagatcccaacctgtggtgtaattgacgtgcgc

SEQ ID NO: 21116 - DNA, 60 bp, Artificial Sequence
  Description of Artificial Sequence: Synthetic probe
aggaagcatacatgtcaactgtgctacctgaagcactcgaagcagatcccaacctgtggt

SEQ ID NO: 21117 - DNA, 60 bp, Artificial Sequence
  Description of Artificial Sequence: Synthetic probe
gcggatcggtgggaatggcttattaattacatggataggaagcatacatgtcaactgtgc

SEQ ID NO: 21118 - DNA, 60 bp, Artificial Sequence
  Description of Artificial Sequence: Synthetic probe
gcatgatatcccgaccagagatcatcgcggtatggaagttgcagaaccagaagtgttggg

SEQ ID NO: 21119 - DNA, 60 bp, Artificial Sequence
  Description of Artificial Sequence: Synthetic probe
ctacggggtcgcgcgtgatggacgcagctgattgtttccgtaactctgccgatcgcaaca

SEQ ID NO: 21120 - DNA, 60 bp, Artificial Sequence
  Description of Artificial Sequence: Synthetic probe
gtgtagcccactttgcacgggtgtgggttgcacaaacggtgtgtcggttgtgggaggtgt

SEQ ID NO: 21121 - DNA, 60 bp, Artificial Sequence
  Description of Artificial Sequence: Synthetic probe
ggtatgccccgagtgcgccgatgccatcatctatgcctacggttgcccttgaaatactgg

SEQ ID NO: 21122 - DNA, 60 bp, Artificial Sequence
  Description of Artificial Sequence: Synthetic probe
ggtatgccccgagtgcgccgatgccatcatctatgcctacggttgcccttgaaatattgg

SEQ ID NO: 21123 - DNA, 60 bp, Artificial Sequence
  Description of Artificial Sequence: Synthetic probe
catttcgctgggttcgcagcacccgcgtgtgagagcggagaagttatcaatctcgctgcg

SEQ ID NO: 21124 - DNA, 60 bp, Artificial Sequence
  Description of Artificial Sequence: Synthetic probe
tatgcggaaaaggttcatttcgctgggttcgcagcacccgcgtgtgagagcggagaagtt

SEQ ID NO: 21125 - DNA, 60 bp, Artificial Sequence
  Description of Artificial Sequence: Synthetic probe
ggaagcgcgagtgaggagatcgggtgatgagaattggcaaagctggctgctgcctatgat

SEQ ID NO: 21126 - DNA, 60 bp, Artificial Sequence
  Description of Artificial Sequence: Synthetic probe
tggaagcgcgagtgaggagatcgggtgatgagaattggcaaagctggctgctgcctatga

SEQ ID NO: 21127 - DNA, 50 bp, Artificial Sequence
  Description of Artificial Sequence: Synthetic probe
gctgaagagatcagatatgtgcagcagctttttggaaaggttccgacagg

SEQ ID NO: 21128 - DNA, 60 bp, Artificial Sequence
  Description of Artificial Sequence: Synthetic probe
gccgattcagctgatcaattttttgaggatggacgattttgcgaagcattttaacaggta

SEQ ID NO: 21129 - DNA, 60 bp, Artificial Sequence
  Description of Artificial Sequence: Synthetic probe
gccgattcagctgatcaattttttgaagatggacgattttgcgaagcattttaacaggta

SEQ ID NO: 21130 - DNA, 60 bp, Artificial Sequence
  Description of Artificial Sequence: Synthetic probe
ggatcgatccaatcctgtttggcattcgcaggcagcacaatcaaatcaaacgtgaggttg

SEQ ID NO: 21131 - DNA, 60 bp, Artificial Sequence
  Description of Artificial Sequence: Synthetic probe
ggatcgatccaaatctgtttggcattcgcaggcagcacaatcaaatcaaacgtgaggttg

SEQ ID NO: 21132 - DNA, 60 bp, Artificial Sequence
  Description of Artificial Sequence: Synthetic probe
cggctgatgattggatcgatccaatcctgtttggcattcgcaggcagcacaatcaaatca

SEQ ID NO: 21133 - DNA, 60 bp, Artificial Sequence
  Description of Artificial Sequence: Synthetic probe
cagataacgaatcatacgggaaatcattgtgatttgtatcctgacgatgtagagatcacg

SEQ ID NO: 21134 - DNA, 61 bp, Artificial Sequence
  Description of Artificial Sequence: Synthetic probe
ggtatttcactgggagtacgaattgattaataaagtgtatcagatatcaaatcatacaggg

SEQ ID NO: 21135 - DNA, 60 bp, Artificial Sequence
  Description of Artificial Sequence: Synthetic probe
acgaaggtatttcactgggagtacgaattgattaataaagtgtatcagatatcaaatcat

SEQ ID NO: 21136 - DNA, 60 bp, Artificial Sequence
  Description of Artificial Sequence: Synthetic probe
ggagagcctgcaacgaaggtatttcactgggagtacgaattgattaataaagtgtatcag

SEQ ID NO: 21137 - DNA, 60 bp, Artificial Sequence
  Description of Artificial Sequence: Synthetic probe
ggagagcctgcaacgaaggtattccactgggagtacgaattgattaataaagtgtatcag

SEQ ID NO: 21138 - DNA, 54 bp, Artificial Sequence
  Description of Artificial Sequence: Synthetic probe
ctgtgatgcgagcatgtgctacgcttcaagaagcaagaattgtattggaagcta

SEQ ID NO: 21139 - DNA, 60 bp, Artificial Sequence
  Description of Artificial Sequence: Synthetic probe
cgacaacgggaccgttcgctattttgaccgggtcaactccaaccgcacagcaacttaatg

SEQ ID NO: 21140 - DNA, 60 bp, Artificial Sequence
  Description of Artificial Sequence: Synthetic probe
gcgcgtacacatccccgatgcacgctcgacgtatgattaggtcgaaaacagtacatccta

SEQ ID NO: 21141 - DNA, 52 bp, Artificial Sequence
  Description of Artificial Sequence: Synthetic probe
tcgatgtcgtacactttgaagatttagccgctcactggcacgcgctaggtgc

SEQ ID NO: 21142 - DNA, 60 bp, Artificial Sequence
  Description of Artificial Sequence: Synthetic probe
atatatagcgcaccgtgggattcagacgatgtcttcttttttcactgtgtgtcccacttt

SEQ ID NO: 21143 - DNA, 60 bp, Artificial Sequence
  Description of Artificial Sequence: Synthetic probe
aaaaggtaataaacgcgttgagtgggattgatttgtcgcacctgcgtacgccgaaaattg

SEQ ID NO: 21144 - DNA, 60 bp, Artificial Sequence
  Description of Artificial Sequence: Synthetic probe
gatccaagaaatagcgggaatgaccgcggatgtgcttgaagccgcgtctgaggaagtacc

SEQ ID NO: 21145 - DNA, 60 bp, Artificial Sequence
  Description of Artificial Sequence: Synthetic probe
tggaggagatttaccaatttatgaatggcgaaatgcgagaagaggcggagcaggaggaac

SEQ ID NO: 21146 - DNA, 60 bp, Artificial Sequence
  Description of Artificial Sequence: Synthetic probe
gtgttaggtgcaggggatgaaattccagacccactaagtcccggcgagcgtgggattcaa

SEQ ID NO: 21147 - DNA, 60 bp, Artificial Sequence
  Description of Artificial Sequence: Synthetic probe
cgggaaggcagcggagcggtttgcggaaagtgagattggatcagcgactatcgatggatt

SEQ ID NO: 21148 - DNA, 60 bp, Artificial Sequence
  Description of Artificial Sequence: Synthetic probe
gcgttgacatcgaatacagcaaagaaaatttatagtacaatcgggaaggcagcggagcgg

SEQ ID NO: 21149 - DNA, 60 bp, Artificial Sequence
  Description of Artificial Sequence: Synthetic probe
cgcggaagatgggcaaaatcataaagtcactgagccgctttggcaaaaaggtggggaatg

SEQ ID NO: 21150 - DNA, 59 bp, Artificial Sequence
  Description of Artificial Sequence: Synthetic probe
aagagagcagcaaagaggctaaagatgcagatgtggatgaccgcatacatactgcagtg

SEQ ID NO: 21151 - DNA, 60 bp, Artificial Sequence
  Description of Artificial Sequence: Synthetic probe
gattatacccaacatatggctacaattggtgtactagcgacgccagagataccctttaca

SEQ ID NO: 21152 - DNA, 60 bp, Artificial Sequence
  Description of Artificial Sequence: Synthetic probe
gattatacccaacatatggctacaattggtgtactagcgacgccagagataccttttaca

SEQ ID NO: 21153 - DNA, 60 bp, Artificial Sequence
  Description of Artificial Sequence: Synthetic probe
gatgatgcgaagagaagatacaagatacgtttgcagaggtttagaacgcacgtacctaag

SEQ ID NO: 21154 - DNA, 60 bp, Artificial Sequence
  Description of Artificial Sequence: Synthetic probe
actgatgatgcgaagaaaaggtacaagatacgtttgcagaggtttagaacgcacgtacct

SEQ ID NO: 21155 - DNA, 60 bp, Artificial Sequence
  Description of Artificial Sequence: Synthetic probe
tgttgtaactgatgatgcgaagagaagatacaagatacgtttgcagaggtttagaacgca

SEQ ID NO: 21156 - DNA, 60 bp, Artificial Sequence
  Description of Artificial Sequence: Synthetic probe
taaggtggcggcttcaatttttgatacagtggcgaagtgtggacatgaagcttcacctag

SEQ ID NO: 21157 - DNA, 60 bp, Artificial Sequence
  Description of Artificial Sequence: Synthetic probe
tccagtatcgagtgttgacgttgcgaatcgaatcgcggtggacaaagggttcgacacgct

SEQ ID NO: 21158 - DNA, 60 bp, Artificial Sequence
  Description of Artificial Sequence: Synthetic probe
ccccaagggagtgctcccagtatcgagtgttgacgttgcgaatcgaatcgcggttgacaa

SEQ ID NO: 21159 - DNA, 60 bp, Artificial Sequence
  Description of Artificial Sequence: Synthetic probe
gtccccaagggagtgcttccagtatcgagtgttgacgttgcgaatcgaatcgcggtggac

SEQ ID NO: 21160 - DNA, 60 bp, Artificial Sequence
  Description of Artificial Sequence: Synthetic probe
cggtgaggatgagcttcacagaatttttgtcggtcccgctagatggtttcgaactaccat

SEQ ID NO: 21161 - DNA, 60 bp, Artificial Sequence
  Description of Artificial Sequence: Synthetic probe
cggtgaggatgagcttcacagaattttcgtcggtcccgctagatggtttcgaactaccat

SEQ ID NO: 21162 - DNA, 50 bp, Artificial Sequence
  Description of Artificial Sequence: Synthetic probe
tggcgtttaagcttaacggcacatcaacggaaataccgcagtggtttaag

SEQ ID NO: 21163 - DNA, 60 bp, Artificial Sequence
  Description of Artificial Sequence: Synthetic probe
tacacatgacgttgttagttgccgctgttgttgcgttgttgacgtcggtatgcacgcttt

SEQ ID NO: 21164 - DNA, 57 bp, Artificial Sequence
  Description of Artificial Sequence: Synthetic probe
attactgcgtcacttataatgcgtgactgctaggtgaggggggcatgtacaacttac

SEQ ID NO: 21165 - DNA, 59 bp, Artificial Sequence
  Description of Artificial Sequence: Synthetic probe
gaattactgcgtcacttataatgcgtgactgctaggtgaggggggcatgtacaacttac

SEQ ID NO: 21166 - DNA, 60 bp, Artificial Sequence
  Description of Artificial Sequence: Synthetic probe
ctagaattactgcgtcacttataatgcgtgactgctaggtgaggggggcatgtacaactt

SEQ ID NO: 21167 - DNA, 60 bp, Artificial Sequence
  Description of Artificial Sequence: Synthetic probe
gcagatcccgacctgtggtgtgattgacgtacgcgcatcagagctaactgggtgttcgcc

SEQ ID NO: 21168 - DNA, 60 bp, Artificial Sequence
  Description of Artificial Sequence: Synthetic probe
cgccccgaggtttacgtcgtgcagggtggttgacctcgcggcgtaaactcccactgctgt

SEQ ID NO: 21169 - DNA, 60 bp, Artificial Sequence
  Description of Artificial Sequence: Synthetic probe
ggcgccccgaggtttacgtcgtgcagggtggttgacctcgcggcgtaaattcccactgct

SEQ ID NO: 21170 - DNA, 60 bp, Artificial Sequence
  Description of Artificial Sequence: Synthetic probe
acacgcagcatatggcgacgattggagtgctagcaacgccagagattcctttcacaacag

SEQ ID NO: 21171 - DNA, 60 bp, Artificial Sequence
  Description of Artificial Sequence: Synthetic probe
acacgcagcatatggcgacgattggagtgctagcaacgccagagattcctttcacaacgg

SEQ ID NO: 21172 - DNA, 60 bp, Artificial Sequence
  Description of Artificial Sequence: Synthetic probe
ttgctatacatggtgtaaatccaatgccgggcccgctcacgcgagcaatcgcgcgcgccg

SEQ ID NO: 21173 - DNA, 60 bp, Artificial Sequence
  Description of Artificial Sequence: Synthetic probe
gatacaagtggttttctatatttcaatggataaaactttgaatcaataccccgccttgac

SEQ ID NO: 21174 - DNA, 60 bp, Artificial Sequence
  Description of Artificial Sequence: Synthetic probe
gccgcattgcaaattcataaccctacacagcaaaatgcaatggtgcagatacaagtggtt

SEQ ID NO: 21175 - DNA, 60 bp, Artificial Sequence
  Description of Artificial Sequence: Synthetic probe
cggaggtgttgacatgagggcgggacgtataatcgcgtgggatggacaagccgcattgca

SEQ ID NO: 21176 - DNA, 60 bp, Artificial Sequence
  Description of Artificial Sequence: Synthetic probe
cgatggctcaggggaattcacaacaaacgttggctggtgtaacggttagtgtcggaggtg

SEQ ID NO: 21177 - DNA, 60 bp, Artificial Sequence
  Description of Artificial Sequence: Synthetic probe
tgcgatggctcaggggaattcacaacaaacgttggctggtgtaacggttagtgtcggagg

SEQ ID NO: 21178 - DNA, 60 bp, Artificial Sequence
  Description of Artificial Sequence: Synthetic probe
gtggcccagacatgatccaggtgtcattgaatgccggtgccagaggtgatgtacaacaga

SEQ ID NO: 21179 - DNA, 60 bp, Artificial Sequence
  Description of Artificial Sequence: Synthetic probe
ggtttgtggcccagacatgatccaggtgtcattgaatgccggtgccagaggtgatgtaca

SEQ ID NO: 21180 - DNA, 60 bp, Artificial Sequence
  Description of Artificial Sequence: Synthetic probe
ggtcgttggtttatgcgagccgcgcaagctgtaactgccgtggtttgtggcccagacatg

SEQ ID NO: 21181 - DNA, 60 bp, Artificial Sequence
  Description of Artificial Sequence: Synthetic probe
tatcagcccggtcgttggtttatgcgagccgcgcaagctgtaactgccgtggtttgtggc

SEQ ID NO: 21182 - DNA, 60 bp, Artificial Sequence
  Description of Artificial Sequence: Synthetic probe
gcttacacgagtacgggaggagatgtgaaaacggagttcctgcatttgatcgatcacctc

SEQ ID NO: 21183 - DNA, 60 bp, Artificial Sequence
  Description of Artificial Sequence: Synthetic probe
agcttacacgagtacgggaggagatgtgaaaacggagttcctgcatttgatcgatcacct

SEQ ID NO: 21184 - DNA, 60 bp, Artificial Sequence
  Description of Artificial Sequence: Synthetic probe
agcatacacgagtacgggaggagatgtgaaaacggagttcctgcatttgatcgatcacct

SEQ ID NO: 21185 - DNA, 60 bp, Artificial Sequence
  Description of Artificial Sequence: Synthetic probe
cgcgcagggaggggtacacacaccggtagttacgactaaattagatacgctgaagattca

SEQ ID NO: 21186 - DNA, 60 bp, Artificial Sequence
  Description of Artificial Sequence: Synthetic probe
catggagagatcgggaccaggaagtcggcggatccgtggaataagcgcgtcgtattcgga

SEQ ID NO: 21187 - DNA, 60 bp, Artificial Sequence
  Description of Artificial Sequence: Synthetic probe
atctgagtggtttgaggaagaagcgagcaatcatacacactactctactagtggctgctg

SEQ ID NO: 21188 - DNA, 60 bp, Artificial Sequence
  Description of Artificial Sequence: Synthetic probe
gatctgagtggtttgaggaagaagcgagcaatcatacacactactctactagtggctgct

SEQ ID NO: 21189 - DNA, 60 bp, Artificial Sequence
  Description of Artificial Sequence: Synthetic probe
gaggctaaagagatgattccgggaaccagcagattggagaagctgcgtgaagcgagaagc

SEQ ID NO: 21190 - DNA, 60 bp, Artificial Sequence
  Description of Artificial Sequence: Synthetic probe
gagctaggcatcccagtttataagagaggatttcccgaacatctgcttcgtggttatgag

SEQ ID NO: 21191 - DNA, 60 bp, Artificial Sequence
  Description of Artificial Sequence: Synthetic probe
cgcgatggatgagctaggcatcccagtttataagagaggatttcccgaacacctgctacg

SEQ ID NO: 21192 - DNA, 60 bp, Artificial Sequence
  Description of Artificial Sequence: Synthetic probe
ggcggagaaagctgcattcgcatcgtacgcagaagcgtttcgtgatgatgtaagactcag

SEQ ID NO: 21193 - DNA, 60 bp, Artificial Sequence
  Description of Artificial Sequence: Synthetic probe
gattgaagggttattcacacgtagatcgtcacatgcatccagatgcctctgtgatgaaag

SEQ ID NO: 21194 - DNA, 60 bp, Artificial Sequence
  Description of Artificial Sequence: Synthetic probe
cgccactgtatatggagtatgcggagataggaaccagattcgacgatgaaccaaccgatg

SEQ ID NO: 21195 - DNA, 60 bp, Artificial Sequence
  Description of Artificial Sequence: Synthetic probe
aatgccagaaataccgccactgtatatggagtatgcggagataggaaccagattcgacga

SEQ ID NO: 21196 - DNA, 60 bp, Artificial Sequence
  Description of Artificial Sequence: Synthetic probe
ccgcgaactcaacagccccaaatccatatatatagtgcaccgtgggattccgacgacgtt

SEQ ID NO: 21197 - DNA, 60 bp, Artificial Sequence
  Description of Artificial Sequence: Synthetic probe
aaaattccgcgaactcaacagccccaaatccatatatatagtgcaccgtgggattccgac

SEQ ID NO: 21198 - DNA, 60 bp, Artificial Sequence
  Description of Artificial Sequence: Synthetic probe
gtagggccatcgaaggagcttacaaattaaagaaggttataaacgctctcagcggaatcg

SEQ ID NO: 21199 - DNA, 60 bp, Artificial Sequence
  Description of Artificial Sequence: Synthetic probe
gaggaagtgccactaataggtgcggggatggcgacagccgtagccacgggtagggctatc

SEQ ID NO: 21200 - DNA, 60 bp, Artificial Sequence
  Description of Artificial Sequence: Synthetic probe
tcggaggaagtgccactaataggtgcggggatggcgacagccgtagccacgggtagggct

SEQ ID NO: 21201 - DNA, 60 bp, Artificial Sequence
  Description of Artificial Sequence: Synthetic probe
gtgaagagcttccagatccactaagtccgggtgaacgtggaatgcagacaaagatccgtg

SEQ ID NO: 21202 - DNA, 59 bp, Artificial Sequence
  Description of Artificial Sequence: Synthetic probe
ttatgatgcgggaccgtcaagcaaaataatacattgggagtaccagttgtataagaatg

SEQ ID NO: 21203 - DNA, 60 bp, Artificial Sequence
  Description of Artificial Sequence: Synthetic probe
attatgatgcgggaccgtcaagtaaaataatacattgggagtaccagttgtataagagtg

SEQ ID NO: 21204 - DNA, 60 bp, Artificial Sequence
  Description of Artificial Sequence: Synthetic probe
ttttgggaatcgcaattaatagatacaatgggttaacacttagatcagtcacaatgcggc

SEQ ID NO: 21205 - DNA, 51 bp, Artificial Sequence
  Description of Artificial Sequence: Synthetic probe
tcgcccgtctacaggcaaacatgggacaattccgagcggctctaagacgca

SEQ ID NO: 21206 - DNA, 60 bp, Artificial Sequence
  Description of Artificial Sequence: Synthetic probe
ccgaccagagaccatcgcggtatggaagttgcagaaccggaagtgttgggagttgagttt

SEQ ID NO: 21207 - DNA, 55 bp, Artificial Sequence
  Description of Artificial Sequence: Synthetic probe
ttttgatgatggtttgtgcaaagagtgaaagagccttgaaccagcagatagatat

SEQ ID NO: 21208 - DNA, 60 bp, Artificial Sequence
  Description of Artificial Sequence: Synthetic probe
ggaagtgccttcatggtttaaaagcctaaatcccatgcttggcgttgtcaatttgggagc

SEQ ID NO: 21209 - DNA, 60 bp, Artificial Sequence
  Description of Artificial Sequence: Synthetic probe
aagacggaagtgccttcatggtttaaaagcctaaatcccatgcttggcgttgtcaatttg

SEQ ID NO: 21210 - DNA, 60 bp, Artificial Sequence
  Description of Artificial Sequence: Synthetic probe
gggtgtgggttgcacagacggagtgtcggttgtgggaggtgtaacccattcatacgcctc

SEQ ID NO: 21211 - DNA, 60 bp, Artificial Sequence
  Description of Artificial Sequence: Synthetic probe
gtggcccagacatgatccaagtgtcattgaatgctggtgctagaggtgatgtgcaacaga

SEQ ID NO: 21212 - DNA, 60 bp, Artificial Sequence
  Description of Artificial Sequence: Synthetic probe
gagtgctagcaacgccagagattcctttcacaacagaagctgcgaatgagatcgcacgtg

SEQ ID NO: 21213 - DNA, 60 bp, Artificial Sequence
  Description of Artificial Sequence: Synthetic probe
gagtgctagcaacgccagagattcctttcacaacagaagctgcgaatgagatcgcgcgtg

SEQ ID NO: 21214 - DNA, 60 bp, Artificial Sequence
  Description of Artificial Sequence: Synthetic probe
tatggcgacaattggagtgctagcaacgccagagattcctttcacaacagaagctgcgaa

SEQ ID NO: 21215 - DNA, 60 bp, Artificial Sequence
  Description of Artificial Sequence: Synthetic probe
cctaaggtcggtaggtagagtggcgccccaaggtccgtatcgtgtagagtggttgatctc

SEQ ID NO: 21216 - DNA, 60 bp, Artificial Sequence
  Description of Artificial Sequence: Synthetic probe
agtaggtagagtggcgccccaaggtttgcaccgcgtggagtggttgatccagcgatgcaa

SEQ ID NO: 21217 - DNA, 60 bp, Artificial Sequence
  Description of Artificial Sequence: Synthetic probe
tacgagtggacacctactatgaagagatgtcgcaggttggagatgttataacggaagatg

SEQ ID NO: 21218 - DNA, 60 bp, Artificial Sequence
  Description of Artificial Sequence: Synthetic probe
gcgcacccgaagaaaagtatcgttctaattattgtgggggatgataagcttgaaccacaa

SEQ ID NO: 21219 - DNA, 60 bp, Artificial Sequence
  Description of Artificial Sequence: Synthetic probe
cggtcgttacgtctaaattagatacacttaagttgcacgtagcttccttatgcgcggggc

SEQ ID NO: 21220 - DNA, 60 bp, Artificial Sequence
  Description of Artificial Sequence: Synthetic probe
agatgttccggtcgttacgtctaaattagatacacttaagttgcacgtagcttccttatg

SEQ ID NO: 21221 - DNA, 60 bp, Artificial Sequence
  Description of Artificial Sequence: Synthetic probe
tcaatatgtttcgagtattacactacgacaaagatctctcaaggtgagatagatgttccg

SEQ ID NO: 21222 - DNA, 60 bp, Artificial Sequence
  Description of Artificial Sequence: Synthetic probe
gagacaggatgcggatgacacccataaagaattcggctcaatatgtttcgagtattacac

SEQ ID NO: 21223 - DNA, 60 bp, Artificial Sequence
  Description of Artificial Sequence: Synthetic probe
gcgattcaaagaagagacaggatgcggatgacacccataaagaattcggctcgatatgtt

SEQ ID NO: 21224 - DNA, 60 bp, Artificial Sequence
  Description of Artificial Sequence: Synthetic probe
ggttcaagataatatttcatattggcatagacagtggtcgatcccaatgattttatttga

SEQ ID NO: 21225 - DNA, 60 bp, Artificial Sequence
  Description of Artificial Sequence: Synthetic probe
ctgaaccaaacctactcaccatcgatttcgagaaggatgcttaccttggcgcgcgttctg

SEQ ID NO: 21226 - DNA, 60 bp, Artificial Sequence
  Description of Artificial Sequence: Synthetic probe
ttcaaggcggatgggatcaggaacggttcaaattgcacaacatattgactgaaccaaacc

SEQ ID NO: 21227 - DNA, 60 bp, Artificial Sequence
  Description of Artificial Sequence: Synthetic probe
tgtttgaccgtatgattcaaggcggatgggatcaggaacggttcaaattgcacaacatat

SEQ ID NO: 21228 - DNA, 60 bp, Artificial Sequence
  Description of Artificial Sequence: Synthetic probe
aaatatgtgttcgctcgtcttaatctatttgatactaacttagccgttggggatgaaatc

SEQ ID NO: 21229 - DNA, 60 bp, Artificial Sequence
  Description of Artificial Sequence: Synthetic probe
gcgtgagaggccgttagaggacaataaatatgtgttcgctcgtcttaatctatttgatac

SEQ ID NO: 21230 - DNA, 60 bp, Artificial Sequence
  Description of Artificial Sequence: Synthetic probe
gcgtccagaatatggtcagcgtgagaggccgttagaagacaataaatatgtgttcgctcg

SEQ ID NO: 21231 - DNA, 60 bp, Artificial Sequence
  Description of Artificial Sequence: Synthetic probe
tggagtctgcgtccagaatatggtcagcgtgagaggccgttagaagacaataaatatgtg

SEQ ID NO: 21232 - DNA, 60 bp, Artificial Sequence
  Description of Artificial Sequence: Synthetic probe
caaacatataaatggagtctgcgtccagaatatggtcagcgtgagaggccgttagaggac

SEQ ID NO: 21233 - DNA, 60 bp, Artificial Sequence
  Description of Artificial Sequence: Synthetic probe
ttcacattgcgtcaaacatataaatggagtctgcgtccagaatatggtcagcgtgagagg

SEQ ID NO: 21234 - DNA, 60 bp, Artificial Sequence
  Description of Artificial Sequence: Synthetic probe
gtgagctcggcgatgtgtacttcacattgcgtcaaacgtataaatggagtctgcgtccag

SEQ ID NO: 21235 - DNA, 60 bp, Artificial Sequence
  Description of Artificial Sequence: Synthetic probe
gcgtggtgcgctaattgctgctgagtgtgagctcggcgatgtgtacttcacattgcgtca

SEQ ID NO: 21236 - DNA, 60 bp, Artificial Sequence
  Description of Artificial Sequence: Synthetic probe
atatttaaggtaggtggttccgcaacagatgatgggagattttacgcgctaatcgctata

SEQ ID NO: 21237 - DNA, 60 bp, Artificial Sequence
  Description of Artificial Sequence: Synthetic probe
caagaacacgtaaatatatttaaggtaggtggttccgcaacagatgatgggagattttac

SEQ ID NO: 21238 - DNA, 60 bp, Artificial Sequence
  Description of Artificial Sequence: Synthetic probe
ccaagatacgtgcattggagctctgcaagatactttcagcgatcggacgtaaaatgttag

SEQ ID NO: 21239 - DNA, 60 bp, Artificial Sequence
  Description of Artificial Sequence: Synthetic probe
atcactgttctgttaaccatcaactcttcaattgtatcgttaaagcgaggtcagcaaatg

SEQ ID NO: 21240 - DNA, 54 bp, Artificial Sequence
  Description of Artificial Sequence: Synthetic probe
gctagatataacgctacgcgcttatgataataggaaatccgcaaagaacgcgaa

SEQ ID NO: 21241 - DNA, 60 bp, Artificial Sequence
  Description of Artificial Sequence: Synthetic probe
caagatacctgaatcggatatgatcgacgtaccgaggttaagtatcatagaggctctaaa

SEQ ID NO: 21242 - DNA, 60 bp, Artificial Sequence
  Description of Artificial Sequence: Synthetic probe
gaaacataatcttatcaagatacctgaatcggatatgatcgacgtaccgaggttaagtat

SEQ ID NO: 21243 - DNA, 60 bp, Artificial Sequence
  Description of Artificial Sequence: Synthetic probe
gcgccaactgtgtagatgcgcgacctatctatgcacttggtagcggcagcgggaacacac

SEQ ID NO: 21244 - DNA, 60 bp, Artificial Sequence
  Description of Artificial Sequence: Synthetic probe
ccccgccttgactgctgaaatctttaacgtttatagcttcagagaccatacatggcacgg

SEQ ID NO: 21245 - DNA, 60 bp, Artificial Sequence
  Description of Artificial Sequence: Synthetic probe
taaatcaataccccgccttgactgctgaaatctttaacgtttatagcttcagagaccata

SEQ ID NO: 21246 - DNA, 60 bp, Artificial Sequence
  Description of Artificial Sequence: Synthetic probe
tgcgatggttcagatacaagtcgtgttttacatttccatggataagactttaaatcaata

SEQ ID NO: 21247 - DNA, 60 bp, Artificial Sequence
  Description of Artificial Sequence: Synthetic probe
cgtgggacggacaggccgctctacatgtacataatcccacgcaacagaatgcgatggttc

SEQ ID NO: 21248 - DNA, 60 bp, Artificial Sequence
  Description of Artificial Sequence: Synthetic probe
gcgtgggacggacaggccgctctacatgtacataatcccacgcaacagaatgcgatggtt

SEQ ID NO: 21249 - DNA, 60 bp, Artificial Sequence
  Description of Artificial Sequence: Synthetic probe
cccaacatatggctacaatcggtgtactagcaacgccagagataccttttacgacggaag

SEQ ID NO: 21250 - DNA, 60 bp, Artificial Sequence
  Description of Artificial Sequence: Synthetic probe
tggatatgatgctgtctgcggctgggataaatgttggaccgatatccccagattataccc

SEQ ID NO: 21251 - DNA, 60 bp, Artificial Sequence
  Description of Artificial Sequence: Synthetic probe
cagatataatggattaactttacgaggagtgacgatgcgcccaacctcattggcgcagag

SEQ ID NO: 21252 - DNA, 60 bp, Artificial Sequence
  Description of Artificial Sequence: Synthetic probe
caacagatataatggattaactttacgaggagtgacgatgcgcccaacctcattggcgca

SEQ ID NO: 21253 - DNA, 60 bp, Artificial Sequence
  Description of Artificial Sequence: Synthetic probe
tgccggtcgcgcatccgaagaaatgtatcgttctaatcgtcgtaggagatgataagctcg

SEQ ID NO: 21254 - DNA, 60 bp, Artificial Sequence
  Description of Artificial Sequence: Synthetic probe
acgcggggttggagaggcaaggcgcatcgtttacctaattcagaactcgacggggttgca

SEQ ID NO: 21255 - DNA, 60 bp, Artificial Sequence
  Description of Artificial Sequence: Synthetic probe
acgtcacgtgtatcggtggagcttgcggccggaatacggtcaacgggaacggcaattgga

SEQ ID NO: 21256 - DNA, 60 bp, Artificial Sequence
  Description of Artificial Sequence: Synthetic probe
tccgataggttcggaaaaatgggtacatctcataagacggaccaaaataagaaacagcgg

SEQ ID NO: 21257 - DNA, 60 bp, Artificial Sequence
  Description of Artificial Sequence: Synthetic probe
agattgaccctggtgaaaggatggatccagcagtaagaatggttgcaggcgttgtaggtc

SEQ ID NO: 21258 - DNA, 60 bp, Artificial Sequence
  Description of Artificial Sequence: Synthetic probe
aaagattgaccctggtgaaaggatggatccagcagtaagaatggttgcaggcgttgtagg

SEQ ID NO: 21259 - DNA, 60 bp, Artificial Sequence
  Description of Artificial Sequence: Synthetic probe
cgacaacagggccgttcgctattctgaccgggtcaaccccaaccgcgcagcaacttaatg

SEQ ID NO: 21260 - DNA, 58 bp, Artificial Sequence
  Description of Artificial Sequence: Synthetic probe
agtggattgaaaaagaagcgagcaatcatacataccactctattggtagcagctgtgg

SEQ ID NO: 21261 - DNA, 51 bp, Artificial Sequence
  Description of Artificial Sequence: Synthetic probe
aaattcggatgcaaaatacttggggatcggttggacgtaccactcttctta

SEQ ID NO: 21262 - DNA, 60 bp, Artificial Sequence
  Description of Artificial Sequence: Synthetic probe
gatcgaagaccgtacacccaatctacctgggatcgcttcactatgatgtttcgttcgcgg

SEQ ID NO: 21263 - DNA, 60 bp, Artificial Sequence
  Description of Artificial Sequence: Synthetic probe
ggagtttcttaacctggcgatctctaacgcctacggcacgcaaatgcatacgagacgttt

SEQ ID NO: 21264 - DNA, 60 bp, Artificial Sequence
  Description of Artificial Sequence: Synthetic probe
tgagcatcgatttggttcactatgaagatttgacagctcattggcacgcattgggcgcag

SEQ ID NO: 21265 - DNA, 60 bp, Artificial Sequence
  Description of Artificial Sequence: Synthetic probe
gcgcaccatgggactcagatgacgtgttcttctttcattgcgtttcacaccaccatatga

SEQ ID NO: 21266 - DNA, 60 bp, Artificial Sequence
  Description of Artificial Sequence: Synthetic probe
tgaaatttaagattccgagagcacagcaaccacatattcatatttatagcgcaccatggg

SEQ ID NO: 21267 - DNA, 60 bp, Artificial Sequence
  Description of Artificial Sequence: Synthetic probe
tcgtacaagggatatcccggataatgcgttggcggtaagcgttctatcgaagaaccgtgt

SEQ ID NO: 21268 - DNA, 60 bp, Artificial Sequence
  Description of Artificial Sequence: Synthetic probe
ctatcgagggagcatacaagctcaaaaaagtgataaatgctctaagtgggattgatttga

SEQ ID NO: 21269 - DNA, 60 bp, Artificial Sequence
  Description of Artificial Sequence: Synthetic probe
acgacttgcaacggctttacagaaggaagtaggcgagagaacacgtgtagaaactactat

SEQ ID NO: 21270 - DNA, 60 bp, Artificial Sequence
  Description of Artificial Sequence: Synthetic probe
gattgggaaggcagctgaaagattcgctgaaagtgaaattggatcagcagctatagatgg

SEQ ID NO: 21271 - DNA, 60 bp, Artificial Sequence
  Description of Artificial Sequence: Synthetic probe
atatgattaagaaggaggttatgaagaagcaatcatataatgatgcggtgaggatgagtt

SEQ ID NO: 21272 - DNA, 60 bp, Artificial Sequence
  Description of Artificial Sequence: Synthetic probe
taatcaagcattgatactaacttttcatcagtcggctcatcgtcaaatctagtccctact

SEQ ID NO: 21273 - DNA, 60 bp, Artificial Sequence
  Description of Artificial Sequence: Synthetic probe
ggaaataggggctagatttgacgatgagccgactgatgaaaagttagtatcaatgcttga

SEQ ID NO: 21274 - DNA, 60 bp, Artificial Sequence
  Description of Artificial Sequence: Synthetic probe
actaacttttcatcagtcggctcatcgtcaaatctagtccctacttccgcatattccatg

SEQ ID NO: 21275 - DNA, 60 bp, Artificial Sequence
  Description of Artificial Sequence: Synthetic probe
gaatgccggaaataccgccattatacatggaatatgcggaaataggggctagatttgacg

SEQ ID NO: 21276 - DNA, 60 bp, Artificial Sequence
  Description of Artificial Sequence: Synthetic probe
agtccctacttccgcatattccatgtataatggcggtatttccggcattccataaatttt

SEQ ID NO: 21277 - DNA, 60 bp, Artificial Sequence
  Description of Artificial Sequence: Synthetic probe
cataaagtttatggaatgccggaaataccgccattatacatggaatatgcggaaataggg

SEQ ID NO: 21278 - DNA, 60 bp, Artificial Sequence
  Description of Artificial Sequence: Synthetic probe
cccgcaccctacgtacatgctcagcgttatatacggtactgtggcattgattcgcgagag

SEQ ID NO: 21279 - DNA, 60 bp, Artificial Sequence
  Description of Artificial Sequence: Synthetic probe
cgatgcggagcgcaattgcttgaggattaccgcaaaagtgggatgatggatgaagccgtg

SEQ ID NO: 21280 - DNA, 60 bp, Artificial Sequence
  Description of Artificial Sequence: Synthetic probe
ttcaaaaaacgttcaccaggacggtttagaagggtattatggcacgtatatgatccaata

SEQ ID NO: 21281 - DNA, 57 bp, Artificial Sequence
  Description of Artificial Sequence: Synthetic probe
cagaggaggtacactacgtaggatgcggtgacctacgtaccttgatgcagttcaaaa

SEQ ID NO: 21282 - DNA, 60 bp, Artificial Sequence
  Description of Artificial Sequence: Synthetic probe
cagaggaggtacactacgtaggatgcggtgacctacgtaccttgatgcagttcaaaaaac

SEQ ID NO: 21283 - DNA, 60 bp, Artificial Sequence
  Description of Artificial Sequence: Synthetic probe
aataagtggataatcgctccgatgttcaacgctaagctccgtataaaacatgaagagatc

SEQ ID NO: 21284 - DNA, 60 bp, Artificial Sequence
  Description of Artificial Sequence: Synthetic probe
gggaatataggctgaatcattccacccgggagataacctatgcgcaagggaacccatgtg

SEQ ID NO: 21285 - DNA, 56 bp, Artificial Sequence
  Description of Artificial Sequence: Synthetic probe
atgatgcgctcatggtacgattggagtgttcgaccaacctatacgccttacgaaaa

SEQ ID NO: 21286 - DNA, 60 bp, Artificial Sequence
  Description of Artificial Sequence: Synthetic probe
cgatccgatttcaagaggcaatcgacaataagttccgacaacatgatcctgagcgcctga

SEQ ID NO: 21287 - DNA, 60 bp, Artificial Sequence
  Description of Artificial Sequence: Synthetic probe
ggccaggggatcagacattaattaattttgggagaggtcagaaggtggcaatgaaccaca

SEQ ID NO: 21288 - DNA, 59 bp, Artificial Sequence
  Description of Artificial Sequence: Synthetic probe
agtacgattgggagggcagcggaaagattcgctgaaagtgaaattggctcagcggctat

SEQ ID NO: 21289 - DNA, 60 bp, Artificial Sequence
  Description of Artificial Sequence: Synthetic probe
tggaccgatatctccagattatacccaacatatggcaacaattggtgtactagcaacgcc

SEQ ID NO: 21290 - DNA, 60 bp, Artificial Sequence
  Description of Artificial Sequence: Synthetic probe
acggcgtaaacccaatgccttggccgctcacagctgctattgcacgcgccgcctatgtgt

SEQ ID NO: 21291 - DNA, 60 bp, Artificial Sequence
  Description of Artificial Sequence: Synthetic probe
tgtttatactgttttaagacctgagttcgcgatgcacggcgtaaacccaatgccttggcc

SEQ ID NO: 21292 - DNA, 60 bp, Artificial Sequence
  Description of Artificial Sequence: Synthetic probe
acacatggcacgggcttagaacggctatacgcaacagaactacactgccgaatatgctgc

SEQ ID NO: 21293 - DNA, 60 bp, Artificial Sequence
  Description of Artificial Sequence: Synthetic probe
atagcttcagagatcacacatggcacgggcttagaacggctatacgcaacagaactacac

SEQ ID NO: 21294 - DNA, 60 bp, Artificial Sequence
  Description of Artificial Sequence: Synthetic probe
aaaccttccagcccggacgttggttcatgcgtgccgcccaagcagcaactgcggtagtgt

SEQ ID NO: 21295 - DNA, 60 bp, Artificial Sequence
  Description of Artificial Sequence: Synthetic probe
gaggaaaccttccagcccggacgttggttcatgcgtgccgcccaagcagcaactgcggta

SEQ ID NO: 21296 - DNA, 60 bp, Artificial Sequence
  Description of Artificial Sequence: Synthetic probe
ggggccagcccgtcagccttatggtttcttccttgaaactgaggaaaccttccagcccgg

SEQ ID NO: 21297 - DNA, 60 bp, Artificial Sequence
  Description of Artificial Sequence: Synthetic probe
ttattcagttttgagacctgagttcgcaatccacggcgtaaatccaatgcctggcccgct

SEQ ID NO: 21298 - DNA, 52 bp, Artificial Sequence
  Description of Artificial Sequence: Synthetic probe
gaaatatcggcggcaggcggaagagattatgcgcagtataagtctgagaaag

SEQ ID NO: 21299 - DNA, 54 bp, Artificial Sequence
  Description of Artificial Sequence: Synthetic probe
acgaaatatcggcggcaggcggaagagattatgcgcaatataagtctgagaaag

SEQ ID NO: 21300 - DNA, 60 bp, Artificial Sequence
  Description of Artificial Sequence: Synthetic probe
gtgtactcacgattctgctactgtcgacgctcgcagatgtttattcagttttgagacctg

SEQ ID NO: 21301 - DNA, 60 bp, Artificial Sequence
  Description of Artificial Sequence: Synthetic probe
gatgtgatagacgcatacacactgcagtgggatctggatcaagcgcaaaaggacctggag

SEQ ID NO: 21302 - DNA, 60 bp, Artificial Sequence
  Description of Artificial Sequence: Synthetic probe
cgtgcatgtataggcccaattatcaattactatctagacacaacgatttcgaatggtggc

SEQ ID NO: 21303 - DNA, 60 bp, Artificial Sequence
  Description of Artificial Sequence: Synthetic probe
gaagtggagggcacgctacatgacgtttcgcaggttatggttcatctattcgacaggttc

SEQ ID NO: 21304 - DNA, 60 bp, Artificial Sequence
  Description of Artificial Sequence: Synthetic probe
caccaatcgcttgcccgagatgcatcttatgcagaaattctcagccgacgtagagagaac

SEQ ID NO: 21305 - DNA, 60 bp, Artificial Sequence
  Description of Artificial Sequence: Synthetic probe
gcaatcacgagggcaaccagtgcgatttacatccagatgagggtgagatcgtgaccaagt

SEQ ID NO: 21306 - DNA, 60 bp, Artificial Sequence
  Description of Artificial Sequence: Synthetic probe
cggtcatggtatgaatggagcgtacgtgagggatataagcctcgagatttagatcgccag

SEQ ID NO: 21307 - DNA, 60 bp, Artificial Sequence
  Description of Artificial Sequence: Synthetic probe
gagcgcactcacattaagtctcttgaactatgcaatctattatccgccattggtaggaaa

SEQ ID NO: 21308 - DNA, 60 bp, Artificial Sequence
  Description of Artificial Sequence: Synthetic probe
cggaggacccctgatgaggactttcagattggtaatcctcagtttctaacgctaaggcgc

SEQ ID NO: 21309 - DNA, 60 bp, Artificial Sequence
  Description of Artificial Sequence: Synthetic probe
gtcgattgcatgttatgatatgaggaaaagaatgatgaagagagatggcgtagattttgt

SEQ ID NO: 21310 - DNA, 60 bp, Artificial Sequence
  Description of Artificial Sequence: Synthetic probe
tggcgaggccagagggcgatgagtggagtggccacgatgttacgcatatcccagataggc

SEQ ID NO: 21311 - DNA, 60 bp, Artificial Sequence
  Description of Artificial Sequence: Synthetic probe
ggttgggcgacgattgatgtcgagtatagagaacctgcgccctacgtacatgctcagcgt

SEQ ID NO: 21312 - DNA, 60 bp, Artificial Sequence
  Description of Artificial Sequence: Synthetic probe
ggaagtgatgaagaagcaatcgtataatgatgcggtgaggatgagttttacggaattttc

SEQ ID NO: 21313 - DNA, 60 bp, Artificial Sequence
  Description of Artificial Sequence: Synthetic probe
tgattaagaaggaagtgatgaagaagcaatcgtataatgatgcggtgaggatgagtttta

SEQ ID NO: 21314 - DNA, 60 bp, Artificial Sequence
  Description of Artificial Sequence: Synthetic probe
actactctattagtggccgctgcggttgcgttgctgacatcagtttgcaccctttcaagt

SEQ ID NO: 21315 - DNA, 60 bp, Artificial Sequence
  Description of Artificial Sequence: Synthetic probe
cgagcaatcatacatactactctattagtggccgctgcggttgcgttgctgacatcagtt

SEQ ID NO: 21316 - DNA, 60 bp, Artificial Sequence
  Description of Artificial Sequence: Synthetic probe
gcttaatggtacatcgacggaaataccgcagtggtttaagagtctaaaccccatgcttgg

SEQ ID NO: 21317 - DNA, 60 bp, Artificial Sequence
  Description of Artificial Sequence: Synthetic probe
cacaaccaccaagatatgctccgagtgccccaatgccatcatcaatgccaaccgttgccc

SEQ ID NO: 21318 - DNA, 60 bp, Artificial Sequence
  Description of Artificial Sequence: Synthetic probe
gaacgcagtctccagaaagagctggggatttcgcgtgagggagtggctgaacagacggag

SEQ ID NO: 21319 - DNA, 60 bp, Artificial Sequence
  Description of Artificial Sequence: Synthetic probe
agaacgcagtctccagaaagagctggggatttcgcgtgagggagtggctgagcagacgga

SEQ ID NO: 21320 - DNA, 60 bp, Artificial Sequence
  Description of Artificial Sequence: Synthetic probe
agtagagcgcagtctccagaaagagctggggatttcgcgtgagggagtggctgagcagac

SEQ ID NO: 21321 - DNA, 60 bp, Artificial Sequence
  Description of Artificial Sequence: Synthetic probe
cagatcatcgaagtagagcgcagtctccagaaagagctggggatttcgcgtgagggagtg

SEQ ID NO: 21322 - DNA, 60 bp, Artificial Sequence
  Description of Artificial Sequence: Synthetic probe
cagatcatcgaggtagaacgcagtctccagaaagagctggggatttcgcgtgagggagtg

SEQ ID NO: 21323 - DNA, 60 bp, Artificial Sequence
  Description of Artificial Sequence: Synthetic probe
ggtcccagcacaaatcatcgaagtagatcgcagtctccagaaagagctggggatttcgcg

SEQ ID NO: 21324 - DNA, 60 bp, Artificial Sequence
  Description of Artificial Sequence: Synthetic probe
gggtaaagtcatacgatctctgagtagattcgggaagaaagtaggtagcgcactcacatc

SEQ ID NO: 21325 - DNA, 60 bp, Artificial Sequence
  Description of Artificial Sequence: Synthetic probe
atgggtaaagtcatacgatctctgagtagattcgggaagaaagtaggtagcgcactcaca

SEQ ID NO: 21326 - DNA, 60 bp, Artificial Sequence
  Description of Artificial Sequence: Synthetic probe
aacatcagtggggattatgcaaatgccacgagaacttttttggctatttcaccacaatgg

SEQ ID NO: 21327 - DNA, 60 bp, Artificial Sequence
  Description of Artificial Sequence: Synthetic probe
gggacaggcgctctcacgacaacaaggacaatctacatatgatgaagaggtttcaaagat

SEQ ID NO: 21328 - DNA, 60 bp, Artificial Sequence
  Description of Artificial Sequence: Synthetic probe
cgatgcctgattattttgataagtggataatagcaccgatgtttaacgctaaattacgaa

SEQ ID NO: 21329 - DNA, 60 bp, Artificial Sequence
  Description of Artificial Sequence: Synthetic probe
gttacgatgcctgattattttgataagtggataatagcaccgatgtttaacgctaaatta

SEQ ID NO: 21330 - DNA, 60 bp, Artificial Sequence
  Description of Artificial Sequence: Synthetic probe
caatagatttcgaaaaggatgctaagttgacatctaatgaaggagttacgatgcctgatt

SEQ ID NO: 21331 - DNA, 60 bp, Artificial Sequence
  Description of Artificial Sequence: Synthetic probe
gccacgcagttctattgccaatttaatcatgaatatagcaacgtgtttacctacaggaga

SEQ ID NO: 21332 - DNA, 60 bp, Artificial Sequence
  Description of Artificial Sequence: Synthetic probe
taatcaggagagagttgaagagctaagtctggttcgtgtggatgatacaatttcacaacc

SEQ ID NO: 21333 - DNA, 60 bp, Artificial Sequence
  Description of Artificial Sequence: Synthetic probe
tcaagtgatatgagtgtagcattcaagataaatgggaccaaaacagaagtgccttcgtgg

SEQ ID NO: 21334 - DNA, 60 bp, Artificial Sequence
  Description of Artificial Sequence: Synthetic probe
taagatcagtaggtagagtggcgccccgaggtttgcaccgcgtggagtggttgatccagc

SEQ ID NO: 21335 - DNA, 56 bp, Artificial Sequence
  Description of Artificial Sequence: Synthetic probe
gttaaatttccgtagccatggctgctcagaatgagcaacgtccggagcgaataaaa

SEQ ID NO: 21336 - DNA, 60 bp, Artificial Sequence
  Description of Artificial Sequence: Synthetic probe
gttaaatttccgtagccatggctgctcagaatgagcaacgtccggaacgaataaaaacga

SEQ ID NO: 21337 - DNA, 56 bp, Artificial Sequence
  Description of Artificial Sequence: Synthetic probe
gttaaatttccgtagccatggctgctcagaatgagcaacgtccggaacgaataaaa

SEQ ID NO: 21338 - DNA, 60 bp, Artificial Sequence
  Description of Artificial Sequence: Synthetic probe
gttaaatttccgtagccatggctgctcagaatgagcaacgtccggagcgaataaaaacga

SEQ ID NO: 21339 - DNA, 60 bp, Artificial Sequence
  Description of Artificial Sequence: Synthetic probe
gttaaatttccgtagccatggctgctcagaatgagcagcgtccggagcgaataaaaacga

SEQ ID NO: 21340 - DNA, 58 bp, Artificial Sequence
  Description of Artificial Sequence: Synthetic probe
gttaaatttccgtagccatggctgctcagaatgagcaacgtccggaacgaataaagac

SEQ ID NO: 21341 - DNA, 58 bp, Artificial Sequence
  Description of Artificial Sequence: Synthetic probe
gttaaatttccgtagccatggctgctcagaatgagcaacgtccggaacgaataaaaac

SEQ ID NO: 21342 - DNA, 60 bp, Artificial Sequence
  Description of Artificial Sequence: Synthetic probe
gttaaatttccgtagccatggctgctcagaatgagcaacgtccggagcgaattaaaacga

SEQ ID NO: 21343 - DNA, 56 bp, Artificial Sequence
  Description of Artificial Sequence: Synthetic probe
gttaaatttccgtagccatggctgctcagaatgagcaacgtccagaacgaataaaa

SEQ ID NO: 21344 - DNA, 60 bp, Artificial Sequence
  Description of Artificial Sequence: Synthetic probe
gttaaatttccgtagccatggctgctcagaatgagcaacgtccggagcgaataaagacga

SEQ ID NO: 21345 - DNA, 54 bp, Artificial Sequence
  Description of Artificial Sequence: Synthetic probe
tcaagatagagttgaagagctgagtctagtgcgtgtagatgataccgtttctca

SEQ ID NO: 21346 - DNA, 60 bp, Artificial Sequence
  Description of Artificial Sequence: Synthetic probe
gatgccatcatctatgccaacggttgcccttgaaatattggacaaagcgatgtcaaacac

SEQ ID NO: 21347 - DNA, 60 bp, Artificial Sequence
  Description of Artificial Sequence: Synthetic probe
gcgccgatgccatcatctatgccaacggttgcccttgaaatattggacaaagcgatgtca

SEQ ID NO: 21348 - DNA, 60 bp, Artificial Sequence
  Description of Artificial Sequence: Synthetic probe
cgaggcgtatgattagatcaaagacggtccatcccatctacctaggatccatgcattatg

SEQ ID NO: 21349 - DNA, 60 bp, Artificial Sequence
  Description of Artificial Sequence: Synthetic probe
tgatgacgttttctttttccattgcgtgtcacactttcatgttaatgagtctttctttct

SEQ ID NO: 21350 - DNA, 60 bp, Artificial Sequence
  Description of Artificial Sequence: Synthetic probe
gatataccagataaagaactagctgtaagtatcctggcaaagaataatgcaatcgtggcg

SEQ ID NO: 21351 - DNA, 60 bp, Artificial Sequence
  Description of Artificial Sequence: Synthetic probe
gcggaagcgtttcgtgatgatgtaaggttgagacaaatcaaacgccatgtgaacgagcag

SEQ ID NO: 21352 - DNA, 60 bp, Artificial Sequence
  Description of Artificial Sequence: Synthetic probe
cgttgggtactgctcccatcgctgcagccatcgttaaagctcgcgttggaagaggaggca

SEQ ID NO: 21353 - DNA, 60 bp, Artificial Sequence
  Description of Artificial Sequence: Synthetic probe
ataagggacatgatgcgttgggtactgctcccatcgctgcagccatcgttaaagctcgcg

SEQ ID NO: 21354 - DNA, 60 bp, Artificial Sequence
  Description of Artificial Sequence: Synthetic probe
cttcaacagatcatttgaacctacgcataggaatgagatgctcgagattgctccgctgat

SEQ ID NO: 21355 - DNA, 60 bp, Artificial Sequence
  Description of Artificial Sequence: Synthetic probe
ttagagcagattttgcgacaggaacgggatataatggatgggctacaatagatgttgagt

SEQ ID NO: 21356 - DNA, 60 bp, Artificial Sequence
  Description of Artificial Sequence: Synthetic probe
gatcccggtgagaggatggatccggcagtacggatggtcgctggtgttgtaggtcatcta

SEQ ID NO: 21357 - DNA, 60 bp, Artificial Sequence
  Description of Artificial Sequence: Synthetic probe
ggaccgttcgccattctaaccgggtcaaccccaactgcgcaacaacttaatgacgttagg

SEQ ID NO: 21358 - DNA, 60 bp, Artificial Sequence
  Description of Artificial Sequence: Synthetic probe
gggaccgttcgccattctaaccgggtcaaccccaactgcgcaacaacttaatgacgttag

SEQ ID NO: 21359 - DNA, 60 bp, Artificial Sequence
  Description of Artificial Sequence: Synthetic probe
gccgcagagcaggtgtataagatcgtcaaagttcccagtatttcgttcagacatatcgtg

SEQ ID NO: 21360 - DNA, 60 bp, Artificial Sequence
  Description of Artificial Sequence: Synthetic probe
gcgttagccgcagagcaggtgtataagatcgtcaaagttcccagtatttcgttcagacat

SEQ ID NO: 21361 - DNA, 60 bp, Artificial Sequence
  Description of Artificial Sequence: Synthetic probe
gtgcaagctgattatatgaccgcgacacgagaggttgatttcacggtgccggatgtacaa

SEQ ID NO: 21362 - DNA, 60 bp, Artificial Sequence
  Description of Artificial Sequence: Synthetic probe
tccggctagcgtaagagcggggcgtataaggctaagatttccactaagcgcgcgacatct

SEQ ID NO: 21363 - DNA, 60 bp, Artificial Sequence
  Description of Artificial Sequence: Synthetic probe
cggtgtggattaatagcgtacctggaatacatggttttctttccttccaaggcgattcga

SEQ ID NO: 21364 - DNA, 60 bp, Artificial Sequence
  Description of Artificial Sequence: Synthetic probe
gggttacgatgaaagacgggcggttgttgaaagtacgagacacaagagtttccatacgaa

SEQ ID NO: 21365 - DNA, 60 bp, Artificial Sequence
  Description of Artificial Sequence: Synthetic probe
aaacttaacggtacattagcggagataccaccgtggtttaaaagtctaaatcccatgctt

SEQ ID NO: 21366 - DNA, 60 bp, Artificial Sequence
  Description of Artificial Sequence: Synthetic probe
tatgttgaagcaaaagaacgtagagaagagatcgttaaacctgaggacttatacacatcg

SEQ ID NO: 21367 - DNA, 60 bp, Artificial Sequence
  Description of Artificial Sequence: Synthetic probe
ctcatcagtgtgcggcggtgtgtcggatggtgtagtctggtatctaccgatcactcatcc

SEQ ID NO: 21368 - DNA, 60 bp, Artificial Sequence
  Description of Artificial Sequence: Synthetic probe
cgaaatttgatgacgctaaatactctgagatggtcggggaaattatagatggtggatgga

SEQ ID NO: 21369 - DNA, 60 bp, Artificial Sequence
  Description of Artificial Sequence: Synthetic probe
gccaacacgaaatgatggggtggtcttgccaaggatcgttgacattagcttgaagggata

SEQ ID NO: 21370 - DNA, 60 bp, Artificial Sequence
  Description of Artificial Sequence: Synthetic probe
attcgcatcgtacgcagaagcgtttcgtgatgatgtgaggttgagacaaattaaacgcca

SEQ ID NO: 21371 - DNA, 60 bp, Artificial Sequence
  Description of Artificial Sequence: Synthetic probe
agagaactttgaaccagcaaattgatatgattaagaaagaagtgatgaagaaacaatcgt

SEQ ID NO: 21372 - DNA, 55 bp, Artificial Sequence
  Description of Artificial Sequence: Synthetic probe
tgcattcgcatcgtacgcaaaagcgtttcgtgatgacgtgaggctgagacagatt

SEQ ID NO: 21373 - DNA, 60 bp, Artificial Sequence
  Description of Artificial Sequence: Synthetic probe
gcgatgtcaaacacaacgggtgctacgcaaacacagaaagcagagaaggctgcattcgca

SEQ ID NO: 21374 - DNA, 60 bp, Artificial Sequence
  Description of Artificial Sequence: Synthetic probe
atttcccaaccgccaagatgtgccccgagcgcgcccatgccatcgtcgatgcctactgtt

SEQ ID NO: 21375 - DNA, 60 bp, Artificial Sequence
  Description of Artificial Sequence: Synthetic probe
acacgatttcccaaccgccaagatgtgccccgagcgcgcccatgccatcgtcgatgccta

SEQ ID NO: 21376 - DNA, 60 bp, Artificial Sequence
  Description of Artificial Sequence: Synthetic probe
atgacaaaactacttaacgtttaggtcccgcgacacggacctgtggcctcttacgcttac

SEQ ID NO: 21377 - DNA, 60 bp, Artificial Sequence
  Description of Artificial Sequence: Synthetic probe
cgatccgagcaggcgattagtcggtattattactctcgtagacatatcgcgggtgtcgtg

SEQ ID NO: 21378 - DNA, 60 bp, Artificial Sequence
  Description of Artificial Sequence: Synthetic probe
gcgtcgctgtgttcgggaatcgcggattcgattgtttataccctaccagtcgcacatccc

SEQ ID NO: 21379 - DNA, 60 bp, Artificial Sequence
  Description of Artificial Sequence: Synthetic probe
cacaaggtggggttgatatatccgtggtcacaacgaagatggacacgttaaaggtacact

SEQ ID NO: 21380 - DNA, 60 bp, Artificial Sequence
  Description of Artificial Sequence: Synthetic probe
ggttaatcccggttgaagttggagcttatgcgaacagatttgggatgaagagcttcttta

SEQ ID NO: 21381 - DNA, 60 bp, Artificial Sequence
  Description of Artificial Sequence: Synthetic probe
ggcatagacagtggtctgtcccagtgatactttatggcgatattattaggttaatcccgg

SEQ ID NO: 21382 - DNA, 60 bp, Artificial Sequence
  Description of Artificial Sequence: Synthetic probe
accgcttcttttccttatccaagataacatatcatattggcatagacagtggtctgtccc

SEQ ID NO: 21383 - DNA, 60 bp, Artificial Sequence
  Description of Artificial Sequence: Synthetic probe
ctgacgggcctgagcggttggacgtcctccagaggaactttcctaacttttttcgacgtt

SEQ ID NO: 21384 - DNA, 60 bp, Artificial Sequence
  Description of Artificial Sequence: Synthetic probe
atgaaagacttttcgcaattgatatgttttgtattcgatcattttttcgaaagacacgag

SEQ ID NO: 21385 - DNA, 60 bp, Artificial Sequence
  Description of Artificial Sequence: Synthetic probe
ctatacgttccgcagggttgcgctggagatcttatcgaactatgagaagcttacgccgga

SEQ ID NO: 21386 - DNA, 57 bp, Artificial Sequence
  Description of Artificial Sequence: Synthetic probe
gacagtcggcggtctttgaacacttgaataaacaggacgatttcttcacgctaaccg

SEQ ID NO: 21387 - DNA, 60 bp, Artificial Sequence
  Description of Artificial Sequence: Synthetic probe
ggctacagttattcggtgacgcgttaagtttggaacaacgacagtcggcggtctttgaac

SEQ ID NO: 21388 - DNA, 60 bp, Artificial Sequence
  Description of Artificial Sequence: Synthetic probe
gaacatccactgaatcccttgggtatgctttgggtagctattatgatctaaggctacagt

SEQ ID NO: 21389 - DNA, 60 bp, Artificial Sequence
  Description of Artificial Sequence: Synthetic probe
cgcaacgcgcagagcaaacgacccatggaacaatcgggcggtgcatggatacataagaac

SEQ ID NO: 21390 - DNA, 60 bp, Artificial Sequence
  Description of Artificial Sequence: Synthetic probe
ctatgttcaacgcgaagttacgactagcccatggagaaatcgcaacgcgcagagcaaacg

SEQ ID NO: 21391 - DNA, 60 bp, Artificial Sequence
  Description of Artificial Sequence: Synthetic probe
tgagacgacttatgatgatgggtatctatgtggatcagataaagaggacgatgagttatt

SEQ ID NO: 21392 - DNA, 60 bp, Artificial Sequence
  Description of Artificial Sequence: Synthetic probe
acagtaggagatcagatcgtacattggcgctatgagttatatcccccggttgagacgact

SEQ ID NO: 21393 - DNA, 60 bp, Artificial Sequence
  Description of Artificial Sequence: Synthetic probe
agaacatataaacatattcagagcaggtggacccgctacagatgacggtagattctacgc

SEQ ID NO: 21394 - DNA, 65 bp, Artificial Sequence
  Description of Artificial Sequence: Synthetic probe
cgagatggatttatctacacgatttcaattcaaactagatgagaaatttaccaaaactgactcag

SEQ ID NO: 21395 - DNA, 60 bp, Artificial Sequence
  Description of Artificial Sequence: Synthetic probe
ttctatcaacgattggccgaaaaatgctggatgcgaaggaagagccgaaggacgagatgg

SEQ ID NO: 21396 - DNA, 60 bp, Artificial Sequence
  Description of Artificial Sequence: Synthetic probe
gtcgctggattggtaaaagtgactataaaaggtaaagttcctgctgaaatcggggaagag

SEQ ID NO: 21397 - DNA, 60 bp, Artificial Sequence
  Description of Artificial Sequence: Synthetic probe
ccagaggaacgaagataggaagtagaggagaaccttataataaattcgtcgctggattgg

SEQ ID NO: 21398 - DNA, 60 bp, Artificial Sequence
  Description of Artificial Sequence: Synthetic probe
atattgcaaggagcggcttatggtttgaaatcgacttatgaattgaaagctcacgcggag

SEQ ID NO: 21399 - DNA, 60 bp, Artificial Sequence
  Description of Artificial Sequence: Synthetic probe
gccagctaacgccgatacggtttactatgattattatccactagaaagtaagatgaagaa

SEQ ID NO: 21400 - DNA, 60 bp, Artificial Sequence
  Description of Artificial Sequence: Synthetic probe
gaatggatattcaacctttgaaagtcacgttggatgaccactattctgtgaatcaccagc

SEQ ID NO: 21401 - DNA, 60 bp, Artificial Sequence
  Description of Artificial Sequence: Synthetic probe
tacgtgcgtatgatgatcggaaggcaacgaagaatgcgaaaggggtagagtttatgacta

SEQ ID NO: 21402 - DNA, 60 bp, Artificial Sequence
  Description of Artificial Sequence: Synthetic probe
cagcatagtagacgcactcagttacagacctacaaggaacgatggtattgttgtgccaag

SEQ ID NO: 21403 - DNA, 60 bp, Artificial Sequence
  Description of Artificial Sequence: Synthetic probe
cccacgaatggaggagtttgtcattccagtttattcggagaacgaaattccatatacgct

SEQ ID NO: 21404 - DNA, 60 bp, Artificial Sequence
  Description of Artificial Sequence: Synthetic probe
ttttacgacggaagcggcgaatgaaatagctcgcgtgactggggagacctcgacatgggg

SEQ ID NO: 21405 - DNA, 60 bp, Artificial Sequence
  Description of Artificial Sequence: Synthetic probe
accttttacgacggaagcggcgaatgaaatagctcgcgtgactggggagacctcgacatg

SEQ ID NO: 21406 - DNA, 60 bp, Artificial Sequence
  Description of Artificial Sequence: Synthetic probe
ctgctgccgggataaatgttggaccgatatcgccggattatacccaacatatggctacga

SEQ ID NO: 21407 - DNA, 60 bp, Artificial Sequence
  Description of Artificial Sequence: Synthetic probe
tagatatgatgttgtctgctgccgggataaatgttggaccgatatcgccggattataccc

SEQ ID NO: 21408 - DNA, 54 bp, Artificial Sequence
  Description of Artificial Sequence: Synthetic probe
ctgtgatgcgagcatgcgctacgctccaagaagcaagaattgtgttagaagcca

SEQ ID NO: 21409 - DNA, 60 bp, Artificial Sequence
  Description of Artificial Sequence: Synthetic probe
acaggtataatggattaacattgcgtggagttacaatgagacccacatcattggcgcaaa

SEQ ID NO: 21410 - DNA, 60 bp, Artificial Sequence
  Description of Artificial Sequence: Synthetic probe
tgggcattgcaattaacaggtataatggattaacattgcgtggagttacaatgagaccca

SEQ ID NO: 21411 - DNA, 60 bp, Artificial Sequence
  Description of Artificial Sequence: Synthetic probe
gatgagaaagatgaagaggatagagatgaacgggaggatgaggagcgggtgaagaccctg

SEQ ID NO: 21412 - DNA, 60 bp, Artificial Sequence
  Description of Artificial Sequence: Synthetic probe
atctaaatgagaaagatgaagaggatagagatgaacgggaggatgaggagcaggtgaaga

SEQ ID NO: 21413 - DNA, 60 bp, Artificial Sequence
  Description of Artificial Sequence: Synthetic probe
gtcaactggaatctggatgagaaagatgaagaggatagagatgaacgggaggatgaggag

SEQ ID NO: 21414 - DNA, 60 bp, Artificial Sequence
  Description of Artificial Sequence: Synthetic probe
atcgaagggaagatgaagcggtgcggggtgcaactgctcgaagattaccgcaaaagtggg

SEQ ID NO: 21415 - DNA, 60 bp, Artificial Sequence
  Description of Artificial Sequence: Synthetic probe
gtcgaagggaagatgaagcggtgcggggtgcaactgctcgaagattaccgcaaaagtggg

SEQ ID NO: 21416 - DNA, 60 bp, Artificial Sequence
  Description of Artificial Sequence: Synthetic probe
acgaagaagatgttgaagggaagatgaagcggtgcggggtgcaactgctcgaggattacc

SEQ ID NO: 21417 - DNA, 60 bp, Artificial Sequence
  Description of Artificial Sequence: Synthetic probe
ccgaaccggcatgctccaagggatcagagaggctatggctccctatcgggctttgcgata

SEQ ID NO: 21418 - DNA, 60 bp, Artificial Sequence
  Description of Artificial Sequence: Synthetic probe
ccgctgattgaatctgtttatgcgtctgagctgtccgtgatgaaggtagatatgcgacac

SEQ ID NO: 21419 - DNA, 60 bp, Artificial Sequence
  Description of Artificial Sequence: Synthetic probe
gattgctccgctgattgaatctgtttatgcgtctgagctgtccgtgatgaaggtagatat

SEQ ID NO: 21420 - DNA, 60 bp, Artificial Sequence
  Description of Artificial Sequence: Synthetic probe
gctcgagattgctccgctgattgaatctgtttatgcgtctgagctgtccgtgatgaaggt

SEQ ID NO: 21421 - DNA, 60 bp, Artificial Sequence
  Description of Artificial Sequence: Synthetic probe
tgtctacctacaggagagtacatcgcgccgaacccaaggatttcatcgattacgttgact

SEQ ID NO: 21422 - DNA, 60 bp, Artificial Sequence
  Description of Artificial Sequence: Synthetic probe
gcgacgtgtctacctacaggagagtacatcgcaccgaacccaaggatttcatcgattacg

SEQ ID NO: 21423 - DNA, 60 bp, Artificial Sequence
  Description of Artificial Sequence: Synthetic probe
taatcatgaatatagcgacgtgtctacctacaggagagtacatcgcaccgaacccaagga

SEQ ID NO: 21424 - DNA, 60 bp, Artificial Sequence
  Description of Artificial Sequence: Synthetic probe
cccgtgagggagtggccgagcagacggagagattgagagatctgcggcgaaaagagaaga

SEQ ID NO: 21425 - DNA, 60 bp, Artificial Sequence
  Description of Artificial Sequence: Synthetic probe
ttcccgtgagggagtggccgagcagacggagagattgagagatctgcggcgaaaagagaa

SEQ ID NO: 21426 - DNA, 60 bp, Artificial Sequence
  Description of Artificial Sequence: Synthetic probe
cgtggggaccagcgcgtcagccctatggttttttcctcgaaactgaagagactttccaac

SEQ ID NO: 21427 - DNA, 60 bp, Artificial Sequence
  Description of Artificial Sequence: Synthetic probe
tgaaacggaggaaacgtatcagcccggtcgttggtttatgcgagctgcgcaggctgtgac

SEQ ID NO: 21428 - DNA, 58 bp, Artificial Sequence
  Description of Artificial Sequence: Synthetic probe
tcgatcacctctaaagggtccagggtactctcctgacgtagggcgatttacatcttac

SEQ ID NO: 21429 - DNA, 60 bp, Artificial Sequence
  Description of Artificial Sequence: Synthetic probe
cctcaaggcgatgcgcagaaagaggacaccgaaaaggagaagatgtctgaagaaccagcg

SEQ ID NO: 21430 - DNA, 60 bp, Artificial Sequence
  Description of Artificial Sequence: Synthetic probe
gggaagaagcctcaaggcgatgcgcagaaagaggacaccgaaaaggagaagatgtctgaa

SEQ ID NO: 21431 - DNA, 60 bp, Artificial Sequence
  Description of Artificial Sequence: Synthetic probe
ggtggtgtagagaggaagatcgctccgataggggcgcgagagagcgcggttatgttggtt

SEQ ID NO: 21432 - DNA, 60 bp, Artificial Sequence
  Description of Artificial Sequence: Synthetic probe
gcatgattggtggtgtagagaggaagatcgctccgataggggcgcgagagagcgcggtta

SEQ ID NO: 21433 - DNA, 59 bp, Artificial Sequence
  Description of Artificial Sequence: Synthetic probe
aagccttaacccgatgcttggcgtggtcaatttgggagcaacttttctgatgatggttt

SEQ ID NO: 21434 - DNA, 60 bp, Artificial Sequence
  Description of Artificial Sequence: Synthetic probe
gcggaagcgtttcgtgatgatgtaagactgagacagatcaagcgccatgtgaacgagcag

SEQ ID NO: 21435 - DNA, 60 bp, Artificial Sequence
  Description of Artificial Sequence: Synthetic probe
tgaagagctgagtctagtacgtgtagatgacaccatctctcaaccaccaaggtatgctcc

SEQ ID NO: 21436 - DNA, 60 bp, Artificial Sequence
  Description of Artificial Sequence: Synthetic probe
taatcaagacagagttgaagagctgagtctagtacgtgtagatgacaccatctctcaacc

SEQ ID NO: 21437 - DNA, 60 bp, Artificial Sequence
  Description of Artificial Sequence: Synthetic probe
cgctcgtggctcatcactttcgtgtaacaatccattcttacgtacgatatgaaggtgttc

SEQ ID NO: 21438 - DNA, 60 bp, Artificial Sequence
  Description of Artificial Sequence: Synthetic probe
tttgaaatggttcgatgcattataactctatgctatgcagaaaaggttcactacgctggg

SEQ ID NO: 21439 - DNA, 60 bp, Artificial Sequence
  Description of Artificial Sequence: Synthetic probe
gccgattcagctgatcaattttttgagaatggatgattttgcgaagcgttttaacaggta

SEQ ID NO: 21440 - DNA, 60 bp, Artificial Sequence
  Description of Artificial Sequence: Synthetic probe
taaatccgatgccagggccgctcacacgtgctattgcgcgcgccgcctatgtgtagtcca

SEQ ID NO: 21441 - DNA, 60 bp, Artificial Sequence
  Description of Artificial Sequence: Synthetic probe
acggcgtaaatccgatgccagggccgctcacacgtgctattgcgcgcgccgcctatgtgt

SEQ ID NO: 21442 - DNA, 60 bp, Artificial Sequence
  Description of Artificial Sequence: Synthetic probe
ttgcgattcacggcgtaaatccgatgccagggccgctcacacgtgctattgcacgcgccg

SEQ ID NO: 21443 - DNA, 60 bp, Artificial Sequence
  Description of Artificial Sequence: Synthetic probe
agtttgcgattcacggcgtaaatccgatgccagggccgctcacacgtgctattgcacgcg

SEQ ID NO: 21444 - DNA, 60 bp, Artificial Sequence
  Description of Artificial Sequence: Synthetic probe
tgtttacactgttttaaggccggagtttgcgattcacggcgtaaatccgatgccagggcc

SEQ ID NO: 21445 - DNA, 53 bp, Artificial Sequence
  Description of Artificial Sequence: Synthetic probe
gtataatgttaacgctgagtggggtggaggcgacgactgaaagatgggaagag

SEQ ID NO: 21446 - DNA, 60 bp, Artificial Sequence
  Description of Artificial Sequence: Synthetic probe
cgtggatgatacggtttcacagcctccgagatatgctccgagtgccccaatgccgtcgtc

SEQ ID NO: 21447 - DNA, 60 bp, Artificial Sequence
  Description of Artificial Sequence: Synthetic probe
ctcaacttggggaccggcccgtcagccgtatggcttctttctcgagacagaggaggtgta

SEQ ID NO: 21448 - DNA, 60 bp, Artificial Sequence
  Description of Artificial Sequence: Synthetic probe
gtaactggagagacctcaacttggggaccggcccgtcagccgtatggcttctttctcgag

SEQ ID NO: 21449 - DNA, 60 bp, Artificial Sequence
  Description of Artificial Sequence: Synthetic probe
catttacaactgaggcagcgaatgagattgcgcgtgtaactggagagacctcaacttggg

SEQ ID NO: 21450 - DNA, 60 bp, Artificial Sequence
  Description of Artificial Sequence: Synthetic probe
atcttataatgacgcggtgaggatgagttttacagagttctcgtcaatcccgctagatgg

SEQ ID NO: 21451 - DNA, 54 bp, Artificial Sequence
  Description of Artificial Sequence: Synthetic probe
tcacatctcttcttagaaatgcgtgaagcagcgatgacaggcgcttacacttac

SEQ ID NO: 21452 - DNA, 54 bp, Artificial Sequence
  Description of Artificial Sequence: Synthetic probe
tcacatctcttcttagaaatgcgtgaagcagcgacgacaggcgcttacacttac

SEQ ID NO: 21453 - DNA, 60 bp, Artificial Sequence
  Description of Artificial Sequence: Synthetic probe
gcacagcggatagtttatgatgatgagttgcagatgcacgtgctgcgtgggccgatacac

SEQ ID NO: 21454 - DNA, 60 bp, Artificial Sequence
  Description of Artificial Sequence: Synthetic probe
cgcacagcggatagtttatgatgatgagttgcagatgcacgtgctgcgtgggccgataca

SEQ ID NO: 21455 - DNA, 60 bp, Artificial Sequence
  Description of Artificial Sequence: Synthetic probe
gagtaacgcacagcggatagtttatgatgatgagttgcagatgcacgtgctgcgtgggcc

SEQ ID NO: 21456 - DNA, 60 bp, Artificial Sequence
  Description of Artificial Sequence: Synthetic probe
gggtcgatgcattatgatatatcctacgctaccttgaagagtaacgcacagcggatagtt

SEQ ID NO: 21457 - DNA, 60 bp, Artificial Sequence
  Description of Artificial Sequence: Synthetic probe
ggatcgatgcactatgatatatcctacgctaccttgaagagtaacgcacagcggatagtt

SEQ ID NO: 21458 - DNA, 60 bp, Artificial Sequence
  Description of Artificial Sequence: Synthetic probe
cccatttatcttggatcgatgcactatgatatatcctacgctaccttgaagagtaacgca

SEQ ID NO: 21459 - DNA, 60 bp, Artificial Sequence
  Description of Artificial Sequence: Synthetic probe
cccatttatcttgggtcgatgcattatgatatatcctacgctaccttgaagagtaacgca

SEQ ID NO: 21460 - DNA, 60 bp, Artificial Sequence
  Description of Artificial Sequence: Synthetic probe
gcgatgcataagagaagaatgtcacgatcccgtagtgtacatcccatttatcttgggtcg

SEQ ID NO: 21461 - DNA, 60 bp, Artificial Sequence
  Description of Artificial Sequence: Synthetic probe
caagcggagcgatgcataagagaagaatgtcacgatcccgtagtgtacatcccatttatc

SEQ ID NO: 21462 - DNA, 60 bp, Artificial Sequence
  Description of Artificial Sequence: Synthetic probe
cgagcggagcgatgcataagagaagaatgtcacgatcccgtagtgtgcatcccatttatc

SEQ ID NO: 21463 - DNA, 60 bp, Artificial Sequence
  Description of Artificial Sequence: Synthetic probe
gagcgttgcagcgtgagtcggagtcgagaagtgacgaggagaccaagatggtgcgggaat

SEQ ID NO: 21464 - DNA, 60 bp, Artificial Sequence
  Description of Artificial Sequence: Synthetic probe
tagcgagagcgttgcagcgtgagtcggagtcgagaagtgacgaggagaccaagatggtgc

SEQ ID NO: 21465 - DNA, 60 bp, Artificial Sequence
  Description of Artificial Sequence: Synthetic probe
gatcttgcgagaggaagacaagaaaatgttggaattagcgagagcgttgcagcgtgagtc

SEQ ID NO: 21466 - DNA, 60 bp, Artificial Sequence
  Description of Artificial Sequence: Synthetic probe
agactcatacggaaagatcttgcgagaggaagacaagaaaatgttggaattagcgagagc

SEQ ID NO: 21467 - DNA, 60 bp, Artificial Sequence
  Description of Artificial Sequence: Synthetic probe
gcagccacgatagatggattcgttcagggaagcgttcactcgatcatgacgggcgagtct

SEQ ID NO: 21468 - DNA, 60 bp, Artificial Sequence
  Description of Artificial Sequence: Synthetic probe
tgcagccacgatagatggattcgttcagggaagcgttcactcgatcatgacgggcgagtc

SEQ ID NO: 21469 - DNA, 60 bp, Artificial Sequence
  Description of Artificial Sequence: Synthetic probe
ggtgcagccacgatagatggaattgttcagggaagcgttcactcgatcatgacgggcgag

SEQ ID NO: 21470 - DNA, 54 bp, Artificial Sequence
  Description of Artificial Sequence: Synthetic probe
taagtagattcggaaagaaagtggggaacgttctgacgtcaaatacggcgaaaa

SEQ ID NO: 21471 - DNA, 60 bp, Artificial Sequence
  Description of Artificial Sequence: Synthetic probe
catcatcgcagagatgggcaagatcattaaatcattaagtagattcggaaagaaagtggg

SEQ ID NO: 21472 - DNA, 60 bp, Artificial Sequence
  Description of Artificial Sequence: Synthetic probe
gttaaaaagtgtcctcatcatcgcagagatgggcaagatcattaaatcattaagtagatt

SEQ ID NO: 21473 - DNA, 60 bp, Artificial Sequence
  Description of Artificial Sequence: Synthetic probe
tcggaggaagtgccactaataggtgcggggatggcgacagctgtagctacaggtagggcc

SEQ ID NO: 21474 - DNA, 60 bp, Artificial Sequence
  Description of Artificial Sequence: Synthetic probe
cacccaatcgctcaagatgggcacaaagctggctgcgccaactgtgtagatgtgcgacca

SEQ ID NO: 21475 - DNA, 60 bp, Artificial Sequence
  Description of Artificial Sequence: Synthetic probe
gaggcgcgggtgaggagatcgggtgatgagaactggcaaagctggctgctgcctatgatt

SEQ ID NO: 21476 - DNA, 60 bp, Artificial Sequence
  Description of Artificial Sequence: Synthetic probe
ggaagcgcgggtgaggagatcgggtgatgagaactggcaaaactggctgctgcctatgat

SEQ ID NO: 21477 - DNA, 60 bp, Artificial Sequence
  Description of Artificial Sequence: Synthetic probe
ggaagcgcgggtgaggagatcgggtgatgagaactggcaaagctggctgctacctatgat

SEQ ID NO: 21478 - DNA, 60 bp, Artificial Sequence
  Description of Artificial Sequence: Synthetic probe
tggaagcgcgggtgaggagatcgggtgatgagaactggcaaagctggctgctacctatga

SEQ ID NO: 21479 - DNA, 60 bp, Artificial Sequence
  Description of Artificial Sequence: Synthetic probe
tggaggcgcgggtgaggagatcgggtgatgagaactggcaaagctggctgctgcctatga

SEQ ID NO: 21480 - DNA, 60 bp, Artificial Sequence
  Description of Artificial Sequence: Synthetic probe
tggaagcgcgggtgaggagatcgggtgatgagaactggcaaaactggctgctgcctatga

SEQ ID NO: 21481 - DNA, 60 bp, Artificial Sequence
  Description of Artificial Sequence: Synthetic probe
cacgtaagcatatttgtggaattgtatccgtagcaatcgggcagagtggtcaactgaaag

SEQ ID NO: 21482 - DNA, 60 bp, Artificial Sequence
  Description of Artificial Sequence: Synthetic probe
ggtcgccttcgaatattataccaatacaagaatctcccagggaaatgtgcatacgccagt

SEQ ID NO: 21483 - DNA, 60 bp, Artificial Sequence
  Description of Artificial Sequence: Synthetic probe
gcgcgtactagagatgaaggatccctgccagctcgtgtgttttgtgatcgattacatctt

SEQ ID NO: 21484 - DNA, 60 bp, Artificial Sequence
  Description of Artificial Sequence: Synthetic probe
tgtcgtatgtccacattcgggcggagcgttatatacgtttaggaaagttgcattactctt

SEQ ID NO: 21485 - DNA, 58 bp, Artificial Sequence
  Description of Artificial Sequence: Synthetic probe
aatggatcagttcaccaatgtttaatgcgcgtttaagaattgccaaaggagagatcgg

SEQ ID NO: 21486 - DNA, 60 bp, Artificial Sequence
  Description of Artificial Sequence: Synthetic probe
cattggcattatgaagtcaaagcatcggtggaaacaacctatgacagcggatacatgtgt

SEQ ID NO: 21487 - DNA, 60 bp, Artificial Sequence
  Description of Artificial Sequence: Synthetic probe
gatcgcaatcgcggcgacgggcacacaaaagggcagagtgtggaggacaaatcagtatcc

SEQ ID NO: 21488 - DNA, 60 bp, Artificial Sequence
  Description of Artificial Sequence: Synthetic probe
ggacggagtggctagcggctacgtacgataggggcaggattagagcgctggaactatgca

SEQ ID NO: 21489 - DNA, 60 bp, Artificial Sequence
  Description of Artificial Sequence: Synthetic probe
agggaaagcctggaggagagttacgcagtaggacagcccaagtgggtacgtttgactaga

SEQ ID NO: 21490 - DNA, 60 bp, Artificial Sequence
  Description of Artificial Sequence: Synthetic probe
gcgtcgttaaagcgaatgccgccaacgctgatacgatctattatgactatttcccacttg

SEQ ID NO: 21491 - DNA, 60 bp, Artificial Sequence
  Description of Artificial Sequence: Synthetic probe
ccattaacctaagatcagtaggtggagtggcgccccgaggtctgtatcgtgtagagtggt

SEQ ID NO: 21492 - DNA, 60 bp, Artificial Sequence
  Description of Artificial Sequence: Synthetic probe
ccattggagcagctcaaacggcagcgggacgtacgctaacggaagcatatagagagtttc

SEQ ID NO: 21493 - DNA, 60 bp, Artificial Sequence
  Description of Artificial Sequence: Synthetic probe
cttatcaagtgatatgagcgtggccttcaagataaacgggactaagacggaagtgccttc

SEQ ID NO: 21494 - DNA, 60 bp, Artificial Sequence
  Description of Artificial Sequence: Synthetic probe
tcagtctgtaccttatcaagtgatatgagcgtggccttcaagataaacgggactaagacg

SEQ ID NO: 21495 - DNA, 60 bp, Artificial Sequence
  Description of Artificial Sequence: Synthetic probe
ccatctctcaaccaccaagatatgctccaagtgcgccgatgccatcatccatgccaacgg

SEQ ID NO: 21496 - DNA, 60 bp, Artificial Sequence
  Description of Artificial Sequence: Synthetic probe
cgtgtggatgataccatctctcaaccaccaagatatgctccaagtgcgccgatgccatca

SEQ ID NO: 21497 - DNA, 60 bp, Artificial Sequence
  Description of Artificial Sequence: Synthetic probe
acaatcaggatagagttgaagaactaagtttagtgcgtgtggatgataccatctctcaac

SEQ ID NO: 21498 - DNA, 60 bp, Artificial Sequence
  Description of Artificial Sequence: Synthetic probe
ggttgtgtggtatttgcctgtaactcatccgtataaatgcgtcgttgctattgaagtgtg

SEQ ID NO: 21499 - DNA, 60 bp, Artificial Sequence
  Description of Artificial Sequence: Synthetic probe
gtatctttcatcgatttgtggtgggatctcggacggggttgtgtggtatttgcctgtaac

SEQ ID NO: 21500 - DNA, 60 bp, Artificial Sequence
  Description of Artificial Sequence: Synthetic probe
atgttgcttgatacgtatctttcatcgatttgtggtgggatctcggacggggttgtgtgg

SEQ ID NO: 21501 - DNA, 60 bp, Artificial Sequence
  Description of Artificial Sequence: Synthetic probe
gacgaggcgatggttaaggtatccgccgaagtagttaattattacttgaagacgacgatt

SEQ ID NO: 21502 - DNA, 60 bp, Artificial Sequence
  Description of Artificial Sequence: Synthetic probe
tctttccgtcgttgccggatagggagtctactgtcgacgaggcgatggttaaggtatccg

SEQ ID NO: 21503 - DNA, 60 bp, Artificial Sequence
  Description of Artificial Sequence: Synthetic probe
tagagtacatgtgtttctttccgtcgttgccggatagggagtctactgtcgacgaggcga

SEQ ID NO: 21504 - DNA, 60 bp, Artificial Sequence
  Description of Artificial Sequence: Synthetic probe
cccattggaagttggttcctcaaacaataggcagggattggtatcctacctagagtacat

SEQ ID NO: 21505 - DNA, 60 bp, Artificial Sequence
  Description of Artificial Sequence: Synthetic probe
gtggtctatcccattactactgtacgctgatcaggtgaaagtaatcccattggaagttgg

SEQ ID NO: 21506 - DNA, 60 bp, Artificial Sequence
  Description of Artificial Sequence: Synthetic probe
gcgcagtgggtagtgatcggctggatctgattaggtactactttcctgcttttgcgcaaa

SEQ ID NO: 21507 - DNA, 60 bp, Artificial Sequence
  Description of Artificial Sequence: Synthetic probe
gcggatccattggaagagttcacgcatcctcaaattgatttacagcataagtttaatggc

SEQ ID NO: 21508 - DNA, 60 bp, Artificial Sequence
  Description of Artificial Sequence: Synthetic probe
ccctgctcctgatcagcgttttgagataccacgcggatatggaggcggatccattggaag

SEQ ID NO: 21509 - DNA, 60 bp, Artificial Sequence
  Description of Artificial Sequence: Synthetic probe
gagaagatctccctgctcctgatcagcgttttgagataccacgcggatatggaggcggat

SEQ ID NO: 21510 - DNA, 60 bp, Artificial Sequence
  Description of Artificial Sequence: Synthetic probe
tgcaaaagcccacgcatccgtgtatgactctgacgggaagatatgtgctggagaagatct

SEQ ID NO: 21511 - DNA, 60 bp, Artificial Sequence
  Description of Artificial Sequence: Synthetic probe
gagatatactctggctcgttactacgatgtacggccaggaataatgggccgctcattggc

SEQ ID NO: 21512 - DNA, 60 bp, Artificial Sequence
  Description of Artificial Sequence: Synthetic probe
tgatgatcctatgattaagagaagccttaaaccgatgactaatgacccagttgacttaca

SEQ ID NO: 21513 - DNA, 60 bp, Artificial Sequence
  Description of Artificial Sequence: Synthetic probe
cggataactgagacggagattgctacgaataaaagtgatgatcctatgattaagagaagc

SEQ ID NO: 21514 - DNA, 60 bp, Artificial Sequence
  Description of Artificial Sequence: Synthetic probe
tttaattctaagctacggataactgagacggagattgctacgaataaaagtgatgatcct

SEQ ID NO: 21515 - DNA, 60 bp, Artificial Sequence
  Description of Artificial Sequence: Synthetic probe
cctacctggattactataataagtggatcatagcgccaatgtttaattctaagctacgga

SEQ ID NO: 21516 - DNA, 60 bp, Artificial Sequence
  Description of Artificial Sequence: Synthetic probe
atggcgggtggaatgaggaagaattcaaaatgtataaattacttcagagtgacggtaatg

SEQ ID NO: 21517 - DNA, 60 bp, Artificial Sequence
  Description of Artificial Sequence: Synthetic probe
ttggggagataatagatggcgggtggaatgaggaagaattcaaaatgtataaattacttc

SEQ ID NO: 21518 - DNA, 60 bp, Artificial Sequence
  Description of Artificial Sequence: Synthetic probe
tgcttgtgatttgtacccagatagcgatgaggacgtgatagtcacgaaattcgatgagac

SEQ ID NO: 21519 - DNA, 60 bp, Artificial Sequence
  Description of Artificial Sequence: Synthetic probe
tgggagtaccagttgtataagaatgagtggaaggttacccttgaacgaggaaatgcttgt

SEQ ID NO: 21520 - DNA, 60 bp, Artificial Sequence
  Description of Artificial Sequence: Synthetic probe
gggttaatctttttgattatgatgcgggaccgtcaagcaaaataatacattgggagtacc

SEQ ID NO: 21521 - DNA, 60 bp, Artificial Sequence
  Description of Artificial Sequence: Synthetic probe
ctacgcaccccgcgaaagagagcgtgaaacagagaagtatatatttagtagggttaatct

SEQ ID NO: 21522 - DNA, 60 bp, Artificial Sequence
  Description of Artificial Sequence: Synthetic probe
ttacgttcatggtatgattggagtgttcgtagcaactacgcaccccgcgaaagagagcgt

SEQ ID NO: 21523 - DNA, 60 bp, Artificial Sequence
  Description of Artificial Sequence: Synthetic probe
cgtacccatgtctaagaggagcgttaatcgctgcagagtcgaagctgggagatgtttatt

SEQ ID NO: 21524 - DNA, 60 bp, Artificial Sequence
  Description of Artificial Sequence: Synthetic probe
gagcctaagtcgcatcgaaaagatgaagataggttttatgccttattagttatagcagcg

SEQ ID NO: 21525 - DNA, 60 bp, Artificial Sequence
  Description of Artificial Sequence: Synthetic probe
tagattccagcaggcgttagatgaaaaatttcgtttgaatgattcagaaaggaatataat

SEQ ID NO: 21526 - DNA, 60 bp, Artificial Sequence
  Description of Artificial Sequence: Synthetic probe
agtgcggttcatacgcggaaaaggatcctttatattacatgatattccgaccagagatca

SEQ ID NO: 21527 - DNA, 60 bp, Artificial Sequence
  Description of Artificial Sequence: Synthetic probe
aaaggtagacgaagaggctaaagagatgattccgggaatcggcagattggagaagctgcg

SEQ ID NO: 21528 - DNA, 60 bp, Artificial Sequence
  Description of Artificial Sequence: Synthetic probe
caagggaccgagtgctgcgggtggatacatattatgaggagatgtcacaggtgggtgacg

SEQ ID NO: 21529 - DNA, 60 bp, Artificial Sequence
  Description of Artificial Sequence: Synthetic probe
tggtgtgaatgctatgccgggtccgcttacgcgggcgattgctcgtgccgcttatgtgta

SEQ ID NO: 21530 - DNA, 60 bp, Artificial Sequence
  Description of Artificial Sequence: Synthetic probe
gctgccaccgatttttccgccgaatgacagagagagtatacttacaattttgctattgtc

SEQ ID NO: 21531 - DNA, 60 bp, Artificial Sequence
  Description of Artificial Sequence: Synthetic probe
cctcgctcgcagcagagatcttcaatgtatatagctttagagaccacacgtggcatggat

SEQ ID NO: 21532 - DNA, 60 bp, Artificial Sequence
  Description of Artificial Sequence: Synthetic probe
gtgtgggcggagtcgacatgcgggcgggtcggataatcgcgtgggatggccaagccgcac

SEQ ID NO: 21533 - DNA, 60 bp, Artificial Sequence
  Description of Artificial Sequence: Synthetic probe
gtggtgagtggatcagacacggttcaagtgtctttgaacgcaggtgcccggggtgatata

SEQ ID NO: 21534 - DNA, 60 bp, Artificial Sequence
  Description of Artificial Sequence: Synthetic probe
ggctgcaaatgagatagcgcgtgtgactggcgagacgacaacatggggaccagcgcgtca

SEQ ID NO: 21535 - DNA, 60 bp, Artificial Sequence
  Description of Artificial Sequence: Synthetic probe
gggacgagcgttatctaaagagcaggaagggtcggctatagcgagtaaagtggctgcgct

SEQ ID NO: 21536 - DNA, 60 bp, Artificial Sequence
  Description of Artificial Sequence: Synthetic probe
aacagattaaactgaaggatgaacgattcatgagtttgtcaagcgctatgcctcaagcga

SEQ ID NO: 21537 - DNA, 60 bp, Artificial Sequence
  Description of Artificial Sequence: Synthetic probe
tcgcgaattgcgccagaagattaaaaatgaacgagagtcagcgccacggcttcaggttca

SEQ ID NO: 21538 - DNA, 60 bp, Artificial Sequence
  Description of Artificial Sequence: Synthetic probe
gagatgcccgatttgccaggtgtgatgaggtcaaattacgatattcgcgaattgcgccag

SEQ ID NO: 21539 - DNA, 60 bp, Artificial Sequence
  Description of Artificial Sequence: Synthetic probe
gggaattgtacaaccatatatgcggaacgattttgatcggaatgagatgcccgatttgcc

SEQ ID NO: 21540 - DNA, 60 bp, Artificial Sequence
  Description of Artificial Sequence: Synthetic probe
attgcaaagggatgggaattgtacaaccatatatgcggaacgattttgatcggaatgaga

SEQ ID NO: 21541 - DNA, 60 bp, Artificial Sequence
  Description of Artificial Sequence: Synthetic probe
gcaaatgctaaaacactatgcggacggatcgcaaagttgagttcgcaaccgtactgtcag

SEQ ID NO: 21542 - DNA, 60 bp, Artificial Sequence
  Description of Artificial Sequence: Synthetic probe
ggatgcaaatgctaaaacactatgcggacggatcgcaaagttgagttcgcaaccgtactg

SEQ ID NO: 21543 - DNA, 60 bp, Artificial Sequence
  Description of Artificial Sequence: Synthetic probe
acggcgtaaatccgatgcctgggccgctcacacgtgctattgcacgcgccgcctatgtgt

SEQ ID NO: 21544 - DNA, 60 bp, Artificial Sequence
  Description of Artificial Sequence: Synthetic probe
tagaaatgccattaacctgaggacagtaggtagagtggcgccccgaggtttacgtcgtgc

SEQ ID NO: 21545 - DNA, 60 bp, Artificial Sequence
  Description of Artificial Sequence: Synthetic probe
cccgctggatggtttcgaaatgccattaacctgaggacagtaggtagagtggcgccccga

SEQ ID NO: 21546 - DNA, 60 bp, Artificial Sequence
  Description of Artificial Sequence: Synthetic probe
gaaagagccttgaatcagcagattgatatgataaagaaggaagtgatgaagaaacaatct

SEQ ID NO: 21547 - DNA, 60 bp, Artificial Sequence
  Description of Artificial Sequence: Synthetic probe
tcattattatacaacaaattgttacactggagcggaagctttgattacaactgcaatcca

SEQ ID NO: 21548 - DNA, 60 bp, Artificial Sequence
  Description of Artificial Sequence: Synthetic probe
gatcattattatacaacaaattgttacactggagcggaggccttgattacaactgcgatt

SEQ ID NO: 21549 - DNA, 60 bp, Artificial Sequence
  Description of Artificial Sequence: Synthetic probe
ggagatcattattatacaacaaattgttacactggagcggaagctttgattacaactgca

SEQ ID NO: 21550 - DNA, 60 bp, Artificial Sequence
  Description of Artificial Sequence: Synthetic probe
ggagatcattattatacaacaaattgttacactggagcggaggccttgattacaaccgcg

SEQ ID NO: 21551 - DNA, 60 bp, Artificial Sequence
  Description of Artificial Sequence: Synthetic probe
acacagaaggcggagaaagctgcattcgcatcgtacgcagaagcgttttgtgatgatgtg

SEQ ID NO: 21552 - DNA, 60 bp, Artificial Sequence
  Description of Artificial Sequence: Synthetic probe
gcagctgtggttgcgctgttgacatcagtgtgcaccctttcaagcgatatgagtgtggcg

SEQ ID NO: 21553 - DNA, 60 bp, Artificial Sequence
  Description of Artificial Sequence: Synthetic probe
agcagctgtggttgcgctgttgacatcagtgtgcaccctttcaagcgatatgagtgtggc

SEQ ID NO: 21554 - DNA, 60 bp, Artificial Sequence
  Description of Artificial Sequence: Synthetic probe
gggagcctcgatcgattcgtggctagaattactgcgtcacttataatgcgtgactgctag

SEQ ID NO: 21555 - DNA, 60 bp, Artificial Sequence
  Description of Artificial Sequence: Synthetic probe
agagggagcctcgatcgactcgtggctggaattactgcgtcacttataatgcgtgactgc

SEQ ID NO: 21556 - DNA, 60 bp, Artificial Sequence
  Description of Artificial Sequence: Synthetic probe
gcagtgtgcattcagcgttgacgggcgagtcgtatggggagagcgtgaaacaggcggtta

SEQ ID NO: 21557 - DNA, 60 bp, Artificial Sequence
  Description of Artificial Sequence: Synthetic probe
ggcagtgtgcattcagcgttgacgggcgagtcgtatggggagagcgtaaaacaggcggta

SEQ ID NO: 21558 - DNA, 56 bp, Artificial Sequence
  Description of Artificial Sequence: Synthetic probe
aaaagtgtcgctgccatgctatccgggctgatccaaaggttcgaagaagaaaagat

SEQ ID NO: 21559 - DNA, 60 bp, Artificial Sequence
  Description of Artificial Sequence: Synthetic probe
gttaaaaagtgtcgctgccatgctatccgggctgatccaaaggttcgaagaagaaaagat

SEQ ID NO: 21560 - DNA, 60 bp, Artificial Sequence
  Description of Artificial Sequence: Synthetic probe
gtgttctcctactcgcagaagatggggaagataatcaaatcgcttagtcgttttgggaaa

SEQ ID NO: 21561 - DNA, 60 bp, Artificial Sequence
  Description of Artificial Sequence: Synthetic probe
gtgttctcctactcgcagaagatggggaagataatcaaatcgcttagtcgttttggaaaa

SEQ ID NO: 21562 - DNA, 60 bp, Artificial Sequence
  Description of Artificial Sequence: Synthetic probe
gttaaaaagtgttctcctactcgcagaagatggggaagataatcaaatcgcttagtcgtt

SEQ ID NO: 21563 - DNA, 60 bp, Artificial Sequence
  Description of Artificial Sequence: Synthetic probe
cgtatattataccctacgtcacgtgtatcggtggagcttgcggccggaatacggtcaacg

SEQ ID NO: 21564 - DNA, 60 bp, Artificial Sequence
  Description of Artificial Sequence: Synthetic probe
cgaaagttgatgtttacagagatgaggttccagcacagatcatcgaagtagaacgcagtc

SEQ ID NO: 21565 - DNA, 60 bp, Artificial Sequence
  Description of Artificial Sequence: Synthetic probe
cagaggcagattcaaattaatttagtcgattggacagagagtgagaacggaaaagagggt

SEQ ID NO: 21566 - DNA, 60 bp, Artificial Sequence
  Description of Artificial Sequence: Synthetic probe
catgcacaacgctacatacgttattgtttcattgattcgcgtgcgttgatcaatccaaca

SEQ ID NO: 21567 - DNA, 60 bp, Artificial Sequence
  Description of Artificial Sequence: Synthetic probe
ccagagaagttctattcaacgatcattaagaaggtacggttcatacgcggaaaaggatcc

SEQ ID NO: 21568 - DNA, 60 bp, Artificial Sequence
  Description of Artificial Sequence: Synthetic probe
tcacgaaagatgagccagagaagttctattcaacgatcattaagaaggtacggttcatac

SEQ ID NO: 21569 - DNA, 60 bp, Artificial Sequence
  Description of Artificial Sequence: Synthetic probe
tgcacactttcgagtgatatgagtgtggcatttaaacttaatggcacatcagcggaaata

SEQ ID NO: 21570 - DNA, 60 bp, Artificial Sequence
  Description of Artificial Sequence: Synthetic probe
cgtgctgcggcagttagcgtcgagtgtgttgatatgagggccagacgcataatcgcgtgg

SEQ ID NO: 21571 - DNA, 56 bp, Artificial Sequence
  Description of Artificial Sequence: Synthetic probe
caaacggcagcgggacgtacgctaactgaagcatatagagagtttctaaatttggc

SEQ ID NO: 21572 - DNA, 60 bp, Artificial Sequence
  Description of Artificial Sequence: Synthetic probe
tagttcattatgaagatctcaccgcccattggcatgcattgggagcagctcaaacggcag

SEQ ID NO: 21573 - DNA, 60 bp, Artificial Sequence
  Description of Artificial Sequence: Synthetic probe
cttgagtaccgcgcaaaggagattcctgataacgctctggctgttagtgttctatcaaag

SEQ ID NO: 21574 - DNA, 60 bp, Artificial Sequence
  Description of Artificial Sequence: Synthetic probe
ggaggaagatctacagatgcgccggttagctacggcgctgcagaaagagatcggagaaag

SEQ ID NO: 21575 - DNA, 60 bp, Artificial Sequence
  Description of Artificial Sequence: Synthetic probe
tcttacggaggaagatctacagatgcgccggttagctacggcgctgcagaaagagatcgg

SEQ ID NO: 21576 - DNA, 60 bp, Artificial Sequence
  Description of Artificial Sequence: Synthetic probe
cagggttgttacgtaccacaggatcgtatgatgattatctcatcggaaaggaggaaggat

SEQ ID NO: 21577 - DNA, 60 bp, Artificial Sequence
  Description of Artificial Sequence: Synthetic probe
tgcaaaacagggttgttacgtaccacaggatcgtatgatgattatctcatcggaaaggag

SEQ ID NO: 21578 - DNA, 60 bp, Artificial Sequence
  Description of Artificial Sequence: Synthetic probe
atgaaagctggcaaagctggttattaccaatgattatagtgcgggaaggattggaccaac

SEQ ID NO: 21579 - DNA, 60 bp, Artificial Sequence
  Description of Artificial Sequence: Synthetic probe
atgaaaactggcaaagctggttgttaccaatgattatagtgcgggaaggattggaccaac

SEQ ID NO: 21580 - DNA, 60 bp, Artificial Sequence
  Description of Artificial Sequence: Synthetic probe
gacgttaggaagatctacttagcgttaatgtttcctggacagattatacttgatctaaaa

SEQ ID NO: 21581 - DNA, 60 bp, Artificial Sequence
  Description of Artificial Sequence: Synthetic probe
ctgcatttgatcgatcacctctaaagggtccagggtaccttcttgacgtagggcgatttc

SEQ ID NO: 21582 - DNA, 60 bp, Artificial Sequence
  Description of Artificial Sequence: Synthetic probe
caaattcacatatacagtgcgccgtgggactcagacgacgtatttttctttcactgcgtg

SEQ ID NO: 21583 - DNA, 60 bp, Artificial Sequence
  Description of Artificial Sequence: Synthetic probe
cctagatcacagcagccgcaaattcacatatacagtgcgccgtgggactcagacgatgta

SEQ ID NO: 21584 - DNA, 60 bp, Artificial Sequence
  Description of Artificial Sequence: Synthetic probe
tgatgagatttaaggtgcctagatcacagcagccgcaaattcacatatacagtgcgccgt

SEQ ID NO: 21585 - DNA, 60 bp, Artificial Sequence
  Description of Artificial Sequence: Synthetic probe
cggtgtgctacgcactgtacgcgttaaattctttgatgcgcgacccccagacgatatttt

SEQ ID NO: 21586 - DNA, 60 bp, Artificial Sequence
  Description of Artificial Sequence: Synthetic probe
ctgtggttgcgctgttgacatcagtttgtaccctttcaagcgatatgagtgtggccttta

SEQ ID NO: 21587 - DNA, 60 bp, Artificial Sequence
  Description of Artificial Sequence: Synthetic probe
tagtagcggctgtggttgcgctgttgacatcagtttgtaccctttcgagcgatatgagtg

SEQ ID NO: 21588 - DNA, 60 bp, Artificial Sequence
  Description of Artificial Sequence: Synthetic probe
tacacactactctattagtagcggctgtggttgcgctgttgacatcagtttgtacccttt

SEQ ID NO: 21589 - DNA, 60 bp, Artificial Sequence
  Description of Artificial Sequence: Synthetic probe
caatcatataatgatgcggtgaggatgagtttcacagagttctcatcagtcccgctagac

SEQ ID NO: 21590 - DNA, 60 bp, Artificial Sequence
  Description of Artificial Sequence: Synthetic probe
gttaaaatgcaatggtcgcaatcaccgtgcaaggtgcacagctcatcaagcgagtggtcg

SEQ ID NO: 21591 - DNA, 60 bp, Artificial Sequence
  Description of Artificial Sequence: Synthetic probe
cggaaagatgggaagagtggaagtttgagggtgttagcgtgacgccaatggctacgcggg

SEQ ID NO: 21592 - DNA, 60 bp, Artificial Sequence
  Description of Artificial Sequence: Synthetic probe
cccgcgtagccattggcgtcacgctaacaccctcaaacttccactcttcccatctttccg

SEQ ID NO: 21593 - DNA, 60 bp, Artificial Sequence
  Description of Artificial Sequence: Synthetic probe
ctggcaaagctggttattacccatgattatagtgcgggaaggattggaccaaccggagag

SEQ ID NO: 21594 - DNA, 60 bp, Artificial Sequence
  Description of Artificial Sequence: Synthetic probe
cttaactctcctacctttatctacacttgctgatgtttacactgttttaaggccggaatt

SEQ ID NO: 21595 - DNA, 60 bp, Artificial Sequence
  Description of Artificial Sequence: Synthetic probe
cttaactctcctacttttatctacacttgctgatgtttacactgttttaaggccggaatt

SEQ ID NO: 21596 - DNA, 60 bp, Artificial Sequence
  Description of Artificial Sequence: Synthetic probe
gccaaacatgctgccaccaattttcccaccaaacgatcgagatagtatcttaactctcct

SEQ ID NO: 21597 - DNA, 60 bp, Artificial Sequence
  Description of Artificial Sequence: Synthetic probe
ctgccaaacatgctgccaccaattttcccaccaaacgatcgagatagtatcttaactctc

SEQ ID NO: 21598 - DNA, 60 bp, Artificial Sequence
  Description of Artificial Sequence: Synthetic probe
ggttgtgttctatatatctatggataagactttaaaccagtaccccgctttgactgctga

SEQ ID NO: 21599 - DNA, 60 bp, Artificial Sequence
  Description of Artificial Sequence: Synthetic probe
ggtgcaaatacaggttgtgttctatatatctatggataagactttaaaccagtaccccgc

SEQ ID NO: 21600 - DNA, 60 bp, Artificial Sequence
  Description of Artificial Sequence: Synthetic probe
attcacaacaaactcaagcgggtgtgactgtcagtgttggtggagttgacatgagggcgg

SEQ ID NO: 21601 - DNA, 60 bp, Artificial Sequence
  Description of Artificial Sequence: Synthetic probe
cgatggcgcaaggtaattcacaacaaactcaagcgggtgtgactgtcagtgttggtggag

SEQ ID NO: 21602 - DNA, 60 bp, Artificial Sequence
  Description of Artificial Sequence: Synthetic probe
attctggggattgctatcaataggtacaatggacttactctacgaggagtgacgatgcgc

SEQ ID NO: 21603 - DNA, 60 bp, Artificial Sequence
  Description of Artificial Sequence: Synthetic probe
gccaatgtgatggaaattctggggattgctatcaataggtacaatggacttactctacga

SEQ ID NO: 21604 - DNA, 60 bp, Artificial Sequence
  Description of Artificial Sequence: Synthetic probe
ctctgcgtcacgtgtatcgatggagcctgcgacctgaatacggtcagcgggaacgacaat

SEQ ID NO: 21605 - DNA, 60 bp, Artificial Sequence
  Description of Artificial Sequence: Synthetic probe
aatcaaatcaaacgtgaggttgagagacaaattaacacatgcccctacactggatacaaa

SEQ ID NO: 21606 - DNA, 53 bp, Artificial Sequence
  Description of Artificial Sequence: Synthetic probe
tgcgcccgacatctttagctcaaagaaatgaaatgttttttatgtgtttagat

SEQ ID NO: 21607 - DNA, 60 bp, Artificial Sequence
  Description of Artificial Sequence: Synthetic probe
gatgaattaatgacgaagctattaaatgtttaggtcccttgacacggaccgatggcctct

SEQ ID NO: 21608 - DNA, 60 bp, Artificial Sequence
  Description of Artificial Sequence: Synthetic probe
gaggtataagtgtaaggtagtactggttaagatgcctggatacgtattcggtaatgatga

SEQ ID NO: 21609 - DNA, 60 bp, Artificial Sequence
  Description of Artificial Sequence: Synthetic probe
cagttttaattattacgcaaacactaagatcgcgcagggaggggtacacacaccggtagt

SEQ ID NO: 21610 - DNA, 60 bp, Artificial Sequence
  Description of Artificial Sequence: Synthetic probe
cgatgacacaattaaattgattcctgtggaggttggggcatacgcgaatcgatttgggat

SEQ ID NO: 21611 - DNA, 60 bp, Artificial Sequence
  Description of Artificial Sequence: Synthetic probe
tagtccagagtttaggtgaaccgcagcgattggatgtgttaagtgtcgcgtcccctaact

SEQ ID NO: 21612 - DNA, 60 bp, Artificial Sequence
  Description of Artificial Sequence: Synthetic probe
tggaagatcatacttatacgcaccccagcatcggcggcgccaatcaaaaacgcatccttg

SEQ ID NO: 21613 - DNA, 60 bp, Artificial Sequence
  Description of Artificial Sequence: Synthetic probe
gatgttgatggcgaattacgaaaggttgagcccagatctgcatgagggtatggaagatca

SEQ ID NO: 21614 - DNA, 60 bp, Artificial Sequence
  Description of Artificial Sequence: Synthetic probe
ttcctgtgctaacgagttatgccaaaggtgatgtggtatgtccccattcgggtggtgcgt

SEQ ID NO: 21615 - DNA, 60 bp, Artificial Sequence
  Description of Artificial Sequence: Synthetic probe
ggatgcgttgagtttgaaacagagccagtcggcggtatttcagcaccagagtcaacaaga

SEQ ID NO: 21616 - DNA, 60 bp, Artificial Sequence
  Description of Artificial Sequence: Synthetic probe
cctgaatacgctctaggacaatatttcgacacgcgtatacaactttatggggatgcgttg

SEQ ID NO: 21617 - DNA, 60 bp, Artificial Sequence
  Description of Artificial Sequence: Synthetic probe
gcgcgtcgtattcggatatgttaaagcgtcaacggaaagccctgaatacgctctaggaca

SEQ ID NO: 21618 - DNA, 60 bp, Artificial Sequence
  Description of Artificial Sequence: Synthetic probe
atagcgtattgacagatccaaatttgctaaccatagattttgagaaggatgcgtacttga

SEQ ID NO: 21619 - DNA, 60 bp, Artificial Sequence
  Description of Artificial Sequence: Synthetic probe
agaagatggagaattggtgtgcaagattagcgaagaaaaatataagacaatgcttgatag

SEQ ID NO: 21620 - DNA, 60 bp, Artificial Sequence
  Description of Artificial Sequence: Synthetic probe
gcccagctgagacaacgtatgacaatggctatatatgcaagactgaacgagaagatggag

SEQ ID NO: 21621 - DNA, 60 bp, Artificial Sequence
  Description of Artificial Sequence: Synthetic probe
cctggaagtcggtgatcaagtagtgcattggaagtacgaaattgatggcccagctgagac

SEQ ID NO: 21622 - DNA, 60 bp, Artificial Sequence
  Description of Artificial Sequence: Synthetic probe
agcggaatgtcaacttggggatgtatatcacaccctacgtcaggtatataaatggagctt

SEQ ID NO: 21623 - DNA, 60 bp, Artificial Sequence
  Description of Artificial Sequence: Synthetic probe
ggacaaatccgtacccgtgtctgagaggtgcgctgatagcagcggaatgtcaacttgggg

SEQ ID NO: 21624 - DNA, 60 bp, Artificial Sequence
  Description of Artificial Sequence: Synthetic probe
tgatagcaattgcggcgaccgatacgcaacgaggtagggtttggaggacaaatccgtacc

SEQ ID NO: 21625 - DNA, 60 bp, Artificial Sequence
  Description of Artificial Sequence: Synthetic probe
catatttaatgtcggagcgcccgcgacgcacgagggtagattttatgctttgatagcaat

SEQ ID NO: 21626 - DNA, 60 bp, Artificial Sequence
  Description of Artificial Sequence: Synthetic probe
cgcgcggctaaacgagatcaggacagaatggatcaatgcacaattcgacagtactaagat

SEQ ID NO: 21627 - DNA, 60 bp, Artificial Sequence
  Description of Artificial Sequence: Synthetic probe
gtgcaagttagaatacaagggcaaacaccacctgaaatagttgatgatatcgcgcggcta

SEQ ID NO: 21628 - DNA, 60 bp, Artificial Sequence
  Description of Artificial Sequence: Synthetic probe
gagggacgcgaattggatataagggcgaagcatatagtcgattcgtttcaagtctagtgc

SEQ ID NO: 21629 - DNA, 60 bp, Artificial Sequence
  Description of Artificial Sequence: Synthetic probe
cacatgctacagggggcagcttactgtctaaaatcaagctatgaactaattacaaattca

SEQ ID NO: 21630 - DNA, 60 bp, Artificial Sequence
  Description of Artificial Sequence: Synthetic probe
ggatggatattcagccattgaaagtagccatagatgatcataacgccgttaatcaccagc

SEQ ID NO: 21631 - DNA, 60 bp, Artificial Sequence
  Description of Artificial Sequence: Synthetic probe
gggatcgtggttcctaggttgcttgacattactcttcgagcgtatgacgatagaaaagcg

SEQ ID NO: 21632 - DNA, 60 bp, Artificial Sequence
  Description of Artificial Sequence: Synthetic probe
ggtgagcattgtggaggctctcgctgctaagcctacgaggaatgatgggatcgtggttcc

SEQ ID NO: 21633 - DNA, 60 bp, Artificial Sequence
  Description of Artificial Sequence: Synthetic probe
aaaccgaaattccatactcattgttaagccactatccgttagctgttcgtacgaacgtta

SEQ ID NO: 21634 - DNA, 60 bp, Artificial Sequence
  Description of Artificial Sequence: Synthetic probe
tcctaactcttttgctgttgtctacgcttgcagatgtttatactgttttgagacctgagt

SEQ ID NO: 21635 - DNA, 60 bp, Artificial Sequence
  Description of Artificial Sequence: Synthetic probe
gctgccacctattttcccaccgaatgatcgagatagtatcctaactcttttgctgttgtc

SEQ ID NO: 21636 - DNA, 60 bp, Artificial Sequence
  Description of Artificial Sequence: Synthetic probe
ggcacggattaaggacggccatactgaatagaactacactgccaaatatgctgccaccta

SEQ ID NO: 21637 - DNA, 60 bp, Artificial Sequence
  Description of Artificial Sequence: Synthetic probe
ccccgctttgaccgctgaaatcttcaacgtttatagcttcagagaccacacatggcacgg

SEQ ID NO: 21638 - DNA, 60 bp, Artificial Sequence
  Description of Artificial Sequence: Synthetic probe
acaagttgtgttttatgtttccatggataagactctaaatcaataccccgctttgaccgc

SEQ ID NO: 21639 - DNA, 60 bp, Artificial Sequence
  Description of Artificial Sequence: Synthetic probe
gggtaactcacagcagactcaagcaggcgtgacggtcagcgttggcggagtagatatgcg

SEQ ID NO: 21640 - DNA, 60 bp, Artificial Sequence
  Description of Artificial Sequence: Synthetic probe
tcgcgatggcgcagggtaactcacagcagactcaagcaggcgtgacggtcagcgttggcg

SEQ ID NO: 21641 - DNA, 60 bp, Artificial Sequence
  Description of Artificial Sequence: Synthetic probe
tggagcgagaggagatgtgcaacagatattccagggtcgtaacgatcccatgatgatata

SEQ ID NO: 21642 - DNA, 60 bp, Artificial Sequence
  Description of Artificial Sequence: Synthetic probe
ccgcggtggtgtgtggtccggatatgatacaagtgtcactgaatgctggagcgagaggag

SEQ ID NO: 21643 - DNA, 60 bp, Artificial Sequence
  Description of Artificial Sequence: Synthetic probe
ctgtgatgcgagcatgtgctacgcttcaggaagcaagaatcgtattggaagctaatgtga

SEQ ID NO: 21644 - DNA, 60 bp, Artificial Sequence
  Description of Artificial Sequence: Synthetic probe
gatggtgcgatgcatcattactctgtgttatgctgagaaggttcactttgctggattcac

SEQ ID NO: 21645 - DNA, 60 bp, Artificial Sequence
  Description of Artificial Sequence: Synthetic probe
gccactatgtttgagatggtgcgatgcatcattactctgtgttatgctgagaaggttcac

SEQ ID NO: 21646 - DNA, 60 bp, Artificial Sequence
  Description of Artificial Sequence: Synthetic probe
ccggagagatggaagtggcttctagattatatggacagaaagcatacgtgtcagctatgc

SEQ ID NO: 21647 - DNA, 60 bp, Artificial Sequence
  Description of Artificial Sequence: Synthetic probe
ttggaccaaccggagagatggaagtggcttctagattatatggacagaaagcatacgtgt

SEQ ID NO: 21648 - DNA, 60 bp, Artificial Sequence
  Description of Artificial Sequence: Synthetic probe
gtgaggagatcgggtgatgaaaactggcaaagctggttattaccgatgattatagtgcgg

SEQ ID NO: 21649 - DNA, 60 bp, Artificial Sequence
  Description of Artificial Sequence: Synthetic probe
gatgctgcagatgattggatcgatccaaatttgttcggaatccgggggcaacacaatcag

SEQ ID NO: 21650 - DNA, 60 bp, Artificial Sequence
  Description of Artificial Sequence: Synthetic probe
ccaactggtcgaattggctaaagaggcgatgtatgatcgagagacggtttggctccaatg

SEQ ID NO: 21651 - DNA, 60 bp, Artificial Sequence
  Description of Artificial Sequence: Synthetic probe
tcaactggttgaattagctaaagaggcgatgtatgatcgagagacggtttggctccaatg

SEQ ID NO: 21652 - DNA, 60 bp, Artificial Sequence
  Description of Artificial Sequence: Synthetic probe
gcatttcaattggttgaattggctaaagaggcgatgtatgatcgagagacggtttggctc

SEQ ID NO: 21653 - DNA, 60 bp, Artificial Sequence
  Description of Artificial Sequence: Synthetic probe
gcgacatctttcgttgatgcagaggagattcccagatgtcctaattcaagcaagaccgtc

SEQ ID NO: 21654 - DNA, 55 bp, Artificial Sequence
  Description of Artificial Sequence: Synthetic probe
taagtgtgggtcaagagggccagttacaggtgtattccaccggtatagtaagaca

SEQ ID NO: 21655 - DNA, 60 bp, Artificial Sequence
  Description of Artificial Sequence: Synthetic probe
ttattcacgcagacatatatgcggagttgtagctgtaagtgtgggtcaagagggccagtt

SEQ ID NO: 21656 - DNA, 60 bp, Artificial Sequence
  Description of Artificial Sequence: Synthetic probe
ctctcggtcggagctagtgttcccaaactactttgacaaatggataaattctcccatgtt

SEQ ID NO: 21657 - DNA, 60 bp, Artificial Sequence
  Description of Artificial Sequence: Synthetic probe
aaactctcggtcggagctagtgttcccaaactactttgacaaatggataaattctcccat

SEQ ID NO: 21658 - DNA, 60 bp, Artificial Sequence
  Description of Artificial Sequence: Synthetic probe
cgttgagcgagtacgggtcggacagattctagctgtattgaacagaagatttgtggcata

SEQ ID NO: 21659 - DNA, 60 bp, Artificial Sequence
  Description of Artificial Sequence: Synthetic probe
tttcccaacatttgcacgcttgatttcgaatgcgcgggaaccgacttatgtgaaagatct

SEQ ID NO: 21660 - DNA, 60 bp, Artificial Sequence
  Description of Artificial Sequence: Synthetic probe
ttatttcccaacatttgcacgcttgatttcgaatgcgcgggaaccgacttatgtgaaaga

SEQ ID NO: 21661 - DNA, 60 bp, Artificial Sequence
  Description of Artificial Sequence: Synthetic probe
gaaggggcttagtttagcgattaaacagacgccatccagtattcatcaagagttggcgaa

SEQ ID NO: 21662 - DNA, 60 bp, Artificial Sequence
  Description of Artificial Sequence: Synthetic probe
gtgagagtatcgatgaaggggcttagtttagcgattaaacagacgccatccagtattcat

SEQ ID NO: 21663 - DNA, 60 bp, Artificial Sequence
  Description of Artificial Sequence: Synthetic probe
cgatctgttaaggtatcatatgtcgcattacatggatgtgagagtatcgatgaaggggct

SEQ ID NO: 21664 - DNA, 60 bp, Artificial Sequence
  Description of Artificial Sequence: Synthetic probe
agacccctacgtaaaacgaacgattaagcctatacgagcggattggatcgatctgttaag

SEQ ID NO: 21665 - DNA, 60 bp, Artificial Sequence
  Description of Artificial Sequence: Synthetic probe
acaacgaaagaatgaagacccctacgtaaaacgaacgattaagcctatacgagcggattg

SEQ ID NO: 21666 - DNA, 60 bp, Artificial Sequence
  Description of Artificial Sequence: Synthetic probe
cacgctccaatgttcaatgcaaaagtgaaaccatgtgaagttgagttagcacaacgaaag

SEQ ID NO: 21667 - DNA, 60 bp, Artificial Sequence
  Description of Artificial Sequence: Synthetic probe
ggaaggtaaccccttactatatgatctagagaaggatattaggttggatagtaggtcaca

SEQ ID NO: 21668 - DNA, 60 bp, Artificial Sequence
  Description of Artificial Sequence: Synthetic probe
gaaggatggaagcacagagactttaagatgtttaagattttgaaggaggaaggtaacccc

SEQ ID NO: 21669 - DNA, 60 bp, Artificial Sequence
  Description of Artificial Sequence: Synthetic probe
ggacgtgttaacctctttgacttagaaggagagcccgcaacgaaggtatttcactgggag

SEQ ID NO: 21670 - DNA, 60 bp, Artificial Sequence
  Description of Artificial Sequence: Synthetic probe
aatacatcgtcggacgtgttaacctctttgacttagaaggagagcccgcaacgaaggtat

SEQ ID NO: 21671 - DNA, 60 bp, Artificial Sequence
  Description of Artificial Sequence: Synthetic probe
gcaagctcggtgacgtgtaccataaattaagggcgtggtatgagtggagcgtgagacctg

SEQ ID NO: 21672 - DNA, 60 bp, Artificial Sequence
  Description of Artificial Sequence: Synthetic probe
cttatccatgtctacgtggcgcgctgatcgcgtctgaatgcaagctcggtgacgtgtacc

SEQ ID NO: 21673 - DNA, 60 bp, Artificial Sequence
  Description of Artificial Sequence: Synthetic probe
tatggtggtcaaatccttatccatgtctacgtggcgcgctgatcgcgtctgaatgcaagc

SEQ ID NO: 21674 - DNA, 60 bp, Artificial Sequence
  Description of Artificial Sequence: Synthetic probe
tttttatgtgttgctaatgattgcggcatcagacacaaataatggtagagtatggtggtc

SEQ ID NO: 21675 - DNA, 60 bp, Artificial Sequence
  Description of Artificial Sequence: Synthetic probe
cgcgaccgcagcattgtggaatcgcgcgtgaggagatcgggtgatgaaaactggcaaagc

SEQ ID NO: 21676 - DNA, 60 bp, Artificial Sequence
  Description of Artificial Sequence: Synthetic probe
cacctatatgtggcgttaatgtcaggtgcttacgtcacagacttgttctggtggtttaag

SEQ ID NO: 21677 - DNA, 52 bp, Artificial Sequence
  Description of Artificial Sequence: Synthetic probe
cgtgtcgaatcttctgtgttaagggttcggaatcctacacttcacgagacag

SEQ ID NO: 21678 - DNA, 52 bp, Artificial Sequence
  Description of Artificial Sequence: Synthetic probe
tcttggatggcaacggcgcgatattattcttgatgtggaagtacccagatat

SEQ ID NO: 21679 - DNA, 60 bp, Artificial Sequence
  Description of Artificial Sequence: Synthetic probe
cggatctattctacttaaccaatagatgcaatatgggtttggagcctagcatttatgagg

SEQ ID NO: 21680 - DNA, 60 bp, Artificial Sequence
  Description of Artificial Sequence: Synthetic probe
cgtaagaatggactgtttcatgagagcgatgagcctcgagcggatctattctacttaacc

SEQ ID NO: 21681 - DNA, 57 bp, Artificial Sequence
  Description of Artificial Sequence: Synthetic probe
atgtgcgtagagtggtcgagatgtttcacggtaaggatcgtgggcgattccttaaga

SEQ ID NO: 21682 - DNA, 60 bp, Artificial Sequence
  Description of Artificial Sequence: Synthetic probe
ggatcgtcacatgcatcccgatgcggcggtgatgaaagttgtgtcccgtgatgtgcgtag

SEQ ID NO: 21683 - DNA, 60 bp, Artificial Sequence
  Description of Artificial Sequence: Synthetic probe
aggaattttatgaaactaaagggttactcacatgtggatcgtcacatgcatcccgatgcg

SEQ ID NO: 21684 - DNA, 60 bp, Artificial Sequence
  Description of Artificial Sequence: Synthetic probe
ccactgtatatcgacttacttgctcccacaaccgggagcggatacggatatgtatgagtt

SEQ ID NO: 21685 - DNA, 60 bp, Artificial Sequence
  Description of Artificial Sequence: Synthetic probe
gcagaagataggttgggtgaagaaatcgcgtatgagatgggcggagctttctctagcgcc

SEQ ID NO: 21686 - DNA, 60 bp, Artificial Sequence
  Description of Artificial Sequence: Synthetic probe
ggttgattccaagaaggacattctaaagcatatgaatttcttaaagcgcgttgaaagatt

SEQ ID NO: 21687 - DNA, 57 bp, Artificial Sequence
  Description of Artificial Sequence: Synthetic probe
gctgaaattggaaataaatttgacgatgaaccgaccgatgagaagttagtctcaatg

SEQ ID NO: 21688 - DNA, 60 bp, Artificial Sequence
  Description of Artificial Sequence: Synthetic probe
catagagtgtatgggataccagaagctcctccgttgtatatggaatatgctgaaattgga

SEQ ID NO: 21689 - DNA, 60 bp, Artificial Sequence
  Description of Artificial Sequence: Synthetic probe
cgagtttcatggatcagaggcggaaacattaaacgatgcaaatcctcggttacatagagt

SEQ ID NO: 21690 - DNA, 60 bp, Artificial Sequence
  Description of Artificial Sequence: Synthetic probe
cggaaaggttttggtgacgcgctaaggagctacgcttctaaggtcgcgatcgagtttcat

SEQ ID NO: 21691 - DNA, 60 bp, Artificial Sequence
  Description of Artificial Sequence: Synthetic probe
atctacacttgccgatgtttacactgttttgagaccagagtttgcgattcacggcgtaaa

SEQ ID NO: 21692 - DNA, 60 bp, Artificial Sequence
  Description of Artificial Sequence: Synthetic probe
tgttggtggagtcgatatgagggcgggacgcattatagcatgggacggacaggccgcgtt

SEQ ID NO: 21693 - DNA, 60 bp, Artificial Sequence
  Description of Artificial Sequence: Synthetic probe
gcgtgactgttagtgttggtggagtcgatatgagggcgggacgcattatagcatgggacg

SEQ ID NO: 21694 - DNA, 60 bp, Artificial Sequence
  Description of Artificial Sequence: Synthetic probe
cgcgctgctcaagcggtgactgcagtagtatgtggtccggatatgattcaggtgtcacta

SEQ ID NO: 21695 - DNA, 60 bp, Artificial Sequence
  Description of Artificial Sequence: Synthetic probe
ttttacaacggaggcggcgaatgagatagctcgcgtgactggggagacctcaacatgggg

SEQ ID NO: 21696 - DNA, 60 bp, Artificial Sequence
  Description of Artificial Sequence: Synthetic probe
accttttacaacggaggcggcgaatgagatagctcgcgtgactggggagacctcaacatg

SEQ ID NO: 21697 - DNA, 60 bp, Artificial Sequence
  Description of Artificial Sequence: Synthetic probe
cctaagatcagtaggtagagtggcgccccgaggtctgcatcgtgtagagtggttgatctc

SEQ ID NO: 21698 - DNA, 60 bp, Artificial Sequence
  Description of Artificial Sequence: Synthetic probe
agaagctgcgtgaagcgagaagcaatgtttttaagggggtggaagctggggtcaactgga

SEQ ID NO: 21699 - DNA, 60 bp, Artificial Sequence
  Description of Artificial Sequence: Synthetic probe
cgacctaggaggcctaaagaagaaaagagctattatacatactacactgctgatagcggc

SEQ ID NO: 21700 - DNA, 60 bp, Artificial Sequence
  Description of Artificial Sequence: Synthetic probe
gcttctctcagccgtatgaggaggatatcgaaggcaagataaaacgatgcggtgcacagc

SEQ ID NO: 21701 - DNA, 60 bp, Artificial Sequence
  Description of Artificial Sequence: Synthetic probe
gcctggtcgttggtttatgcgagctgcgcaggccgtaactgctgtggtgtgtggcccaga

SEQ ID NO: 21702 - DNA, 60 bp, Artificial Sequence
  Description of Artificial Sequence: Synthetic probe
gtatcagcctggtcgttggtttatgcgagctgcgcaggccgtaactgctgtggtgtgtgg

SEQ ID NO: 21703 - DNA, 60 bp, Artificial Sequence
  Description of Artificial Sequence: Synthetic probe
acgtatcagcctggtcgttggtttatgcgagctgcgcaggccgtaactgccgtggagtgt

SEQ ID NO: 21704 - DNA, 60 bp, Artificial Sequence
  Description of Artificial Sequence: Synthetic probe
aaacgtatcagcctggtcgttggtttatgcgagctgcgcaggccgtaactgccggggtgt

SEQ ID NO: 21705 - DNA, 60 bp, Artificial Sequence
  Description of Artificial Sequence: Synthetic probe
tggaacagaggaaacgtatcagcctggtcgttggtttatgcgagctgcgcaggccgtaac

SEQ ID NO: 21706 - DNA, 60 bp, Artificial Sequence
  Description of Artificial Sequence: Synthetic probe
tgaaacagaggaaacgtatcagcctggtcgttggtttatgcgagctgcgcaggccgtaac

SEQ ID NO: 21707 - DNA, 53 bp, Artificial Sequence
  Description of Artificial Sequence: Synthetic probe
gttactcaatgtatgacctgcgtgactgcaggtccgcgatctgtccaacttac

SEQ ID NO: 21708 - DNA, 60 bp, Artificial Sequence
  Description of Artificial Sequence: Synthetic probe
cgtggattcaaagagtgcaccatttagtcaacatcgagatgcttcactgctctcaagagg

SEQ ID NO: 21709 - DNA, 60 bp, Artificial Sequence
  Description of Artificial Sequence: Synthetic probe
cgtggattcaaagagtgcaccatttagtcaacatcgaaatgcttcattgctctcaggagg

SEQ ID NO: 21710 - DNA, 60 bp, Artificial Sequence
  Description of Artificial Sequence: Synthetic probe
cgctcaaagttgataccgcgcacacgagaacgcgagtgagccacgcgttatttaactgta

SEQ ID NO: 21711 - DNA, 60 bp, Artificial Sequence
  Description of Artificial Sequence: Synthetic probe
gctggggatctcgcgtgaaggagtggctgagcaaacggaaagattaagagacctgcggcg

SEQ ID NO: 21712 - DNA, 60 bp, Artificial Sequence
  Description of Artificial Sequence: Synthetic probe
gctggacgtgattatggcgccgataaggaggattgtgcatgtaattccaccatgttggaa

SEQ ID NO: 21713 - DNA, 60 bp, Artificial Sequence
  Description of Artificial Sequence: Synthetic probe
taagactacctttattggagcgtggaagatgaagcggactattaaggaaaatgcgatgta

SEQ ID NO: 21714 - DNA, 60 bp, Artificial Sequence
  Description of Artificial Sequence: Synthetic probe
acgttgtttccaccaagtcattactatatgatatctatctctcatcagtgtgcggcggtg

SEQ ID NO: 21715 - DNA, 55 bp, Artificial Sequence
  Description of Artificial Sequence: Synthetic probe
caattgaggacgcagagaaagcatgcttacatacgagaggtcaattatgtaatca

SEQ ID NO: 21716 - DNA, 60 bp, Artificial Sequence
  Description of Artificial Sequence: Synthetic probe
ttacgaacgattggacccgagtttacatgaggggagggagcatgagacatacacgcatcc

SEQ ID NO: 21717 - DNA, 60 bp, Artificial Sequence
  Description of Artificial Sequence: Synthetic probe
cgaatgctagtcgctgcagggaaagattctgaagcggcgtattttcgcagcatgctaccc

SEQ ID NO: 21718 - DNA, 60 bp, Artificial Sequence
  Description of Artificial Sequence: Synthetic probe
cgcgtgtgcaggttaattatggccctacgggagagccgttggatttccatatcggcagaa

SEQ ID NO: 21719 - DNA, 60 bp, Artificial Sequence
  Description of Artificial Sequence: Synthetic probe
cgaatcacaacgaccgggccctttgcgatattgactggatcaacgccaaccgcacagcag

SEQ ID NO: 21720 - DNA, 60 bp, Artificial Sequence
  Description of Artificial Sequence: Synthetic probe
cccaacgaatcacaacgaccgggccctttgcgatattgactggatcaacgccaaccgcac

SEQ ID NO: 21721 - DNA, 60 bp, Artificial Sequence
  Description of Artificial Sequence: Synthetic probe
ctcaacgaattacaacgaccgggccctttgcgatattgactggatcaacgccaaccgcac

SEQ ID NO: 21722 - DNA, 60 bp, Artificial Sequence
  Description of Artificial Sequence: Synthetic probe
taaatccaatgcccggcccgcttacacgtgcgattgcgcgcgccgcttatgtgtagccca

SEQ ID NO: 21723 - DNA, 60 bp, Artificial Sequence
  Description of Artificial Sequence: Synthetic probe
agcggatgtgtatactgttcttcgacccgaattcgcgatacacggcgtaaatccaatgcc

SEQ ID NO: 21724 - DNA, 60 bp, Artificial Sequence
  Description of Artificial Sequence: Synthetic probe
ggcggagaaagctgcattcgcatcgtacgcggaagcgtttcgtgatgatgtgagactaag

SEQ ID NO: 21725 - DNA, 60 bp, Artificial Sequence
  Description of Artificial Sequence: Synthetic probe
gaattactcacgaagcttctaaatatttaatcccgtgacagggattgggcacgtttacac

SEQ ID NO: 21726 - DNA, 60 bp, Artificial Sequence
  Description of Artificial Sequence: Synthetic probe
gttttcggtaatgatgaattactcacgaagcttctaaatatttaatcccgtgacagggat

SEQ ID NO: 21727 - DNA, 53 bp, Artificial Sequence
  Description of Artificial Sequence: Synthetic probe
gttaaaaacgttagcctagagatggaggagctagttataccagtcataactcg

SEQ ID NO: 21728 - DNA, 60 bp, Artificial Sequence
  Description of Artificial Sequence: Synthetic probe
cgactgtgtagagatgcgacctatctatcagctcggtagcggcagcgggaacacacttac

SEQ ID NO: 21729 - DNA, 60 bp, Artificial Sequence
  Description of Artificial Sequence: Synthetic probe
gccaacgcatcgtaatgagatgctggaagtcgccccattgattgagtctgtctacgcgtc

SEQ ID NO: 21730 - DNA, 60 bp, Artificial Sequence
  Description of Artificial Sequence: Synthetic probe
aattggtatgacttatcactgctataatgagatgctacgtatgctggttgccgcaggtaa

SEQ ID NO: 21731 - DNA, 60 bp, Artificial Sequence
  Description of Artificial Sequence: Synthetic probe
ctcaacgaatcacaacgactggaccctttgctatattgactggatcaacgccaaccgcac

SEQ ID NO: 21732 - DNA, 60 bp, Artificial Sequence
  Description of Artificial Sequence: Synthetic probe
ccgcatatataacagattgcaaggttatatagaggccgtacagctacaagaactcaggaa

SEQ ID NO: 21733 - DNA, 60 bp, Artificial Sequence
  Description of Artificial Sequence: Synthetic probe
cgttgcgactcgtgatgttgatgtgttcatcggtgcgtgttccgaaccagtttaccgcat

SEQ ID NO: 21734 - DNA, 60 bp, Artificial Sequence
  Description of Artificial Sequence: Synthetic probe
catcccaactagggatcatcgcgggatggaagttgcggagccagaagtattaggcgtgga

SEQ ID NO: 21735 - DNA, 60 bp, Artificial Sequence
  Description of Artificial Sequence: Synthetic probe
ggcacatcgttatgcaatcgagagatcgagtattgcgggtagacacatattatgaggaga

SEQ ID NO: 21736 - DNA, 60 bp, Artificial Sequence
  Description of Artificial Sequence: Synthetic probe
tatcttttaggcacatcgttatgcaatcgagagatcgagtattgcgggtagacacatatt

SEQ ID NO: 21737 - DNA, 60 bp, Artificial Sequence
  Description of Artificial Sequence: Synthetic probe
cagggccgttgttatcagtgttcgcgctgcaagagatcatgcagaaagtaagacaggtac

SEQ ID NO: 21738 - DNA, 60 bp, Artificial Sequence
  Description of Artificial Sequence: Synthetic probe
tctgatatataatgtcgagttctcaaatacacctgactccctggtgttgataaacccgac

SEQ ID NO: 21739 - DNA, 60 bp, Artificial Sequence
  Description of Artificial Sequence: Synthetic probe
cctgggagcgttaaagttcggctgtaaggttttaggagatcgtttagacgtaccactctt

SEQ ID NO: 21740 - DNA, 60 bp, Artificial Sequence
  Description of Artificial Sequence: Synthetic probe
gcaggaagaagccatacaggaaatagccgggatgactgcggatgtgttagaggcggcatc

SEQ ID NO: 21741 - DNA, 60 bp, Artificial Sequence
  Description of Artificial Sequence: Synthetic probe
cgcatcgtacgcggaagcgtttcgtgatgatgtaagattaagacaaattaaacgccacgt

SEQ ID NO: 21742 - DNA, 58 bp, Artificial Sequence
  Description of Artificial Sequence: Synthetic probe
tcgcatcgtacgcggaagcgtttcgtgatgatgtaagattgagacaaattaaacgcca

SEQ ID NO: 21743 - DNA, 60 bp, Artificial Sequence
  Description of Artificial Sequence: Synthetic probe
ttcgcatcgtacgcggaagcgtttcgtgatgatgtaagattgagacaaatcaaacgccat

SEQ ID NO: 21744 - DNA, 60 bp, Artificial Sequence
  Description of Artificial Sequence: Synthetic probe
attcgcatcgtacgcggaagcgtttcgtgatgatgtaagattaagacaaattaaacgcca

SEQ ID NO: 21745 - DNA, 60 bp, Artificial Sequence
  Description of Artificial Sequence: Synthetic probe
ctacgcggtccactacatttccaaaggcgagctatattgggtgcgttaaagtttggatgc

SEQ ID NO: 21746 - DNA, 60 bp, Artificial Sequence
  Description of Artificial Sequence: Synthetic probe
tggtagctgctgtggttgcgctgttgacatcactttgcaccctttcaagcgatatgagtg

SEQ ID NO: 21747 - DNA, 60 bp, Artificial Sequence
  Description of Artificial Sequence: Synthetic probe
gaagcgagcaatcatacacaccactctattggtagctgctgtggttgcgctgttgacatc

SEQ ID NO: 21748 - DNA, 60 bp, Artificial Sequence
  Description of Artificial Sequence: Synthetic probe
cttcgacatgggggccagcgcgtcagccttatggttttttccttgaaactgaagaaacct

SEQ ID NO: 21749 - DNA, 60 bp, Artificial Sequence
  Description of Artificial Sequence: Synthetic probe
ccttctaaatgcttgatcgcgcttgaggtttcagatgcactaacgagtcccgaactacgt

SEQ ID NO: 21750 - DNA, 55 bp, Artificial Sequence
  Description of Artificial Sequence: Synthetic probe
ttttatgcggataagatcatgattgtcccggcggaggtaggcgcatactataatc

SEQ ID NO: 21751 - DNA, 60 bp, Artificial Sequence
  Description of Artificial Sequence: Synthetic probe
ccgatccctatgtaaagcggacgcttaagcctttgaaagcggattgcatcgagttaatgc

SEQ ID NO: 21752 - DNA, 60 bp, Artificial Sequence
  Description of Artificial Sequence: Synthetic probe
ggtatgagtggagcgtacgtgagggatataagcctcgggatctagatcgccagtatgaga

SEQ ID NO: 21753 - DNA, 60 bp, Artificial Sequence
  Description of Artificial Sequence: Synthetic probe
cgatcatggtatgagtggagcgtacgtgagggatataagccacgagatctggatcgccag

SEQ ID NO: 21754 - DNA, 60 bp, Artificial Sequence
  Description of Artificial Sequence: Synthetic probe
cggccgagtgtaagttaggtgacgtctattataaattgcgatcatggtatgagtggagcg

SEQ ID NO: 21755 - DNA, 60 bp, Artificial Sequence
  Description of Artificial Sequence: Synthetic probe
cgttaattgcggccgagtgtaagttaggtgacgtctattataaattgcgatcatggtatg

SEQ ID NO: 21756 - DNA, 60 bp, Artificial Sequence
  Description of Artificial Sequence: Synthetic probe
ggtgcgctaatcgcggctgagtgcaaattaggtgacgtctattataaattgcgatcatgg

SEQ ID NO: 21757 - DNA, 60 bp, Artificial Sequence
  Description of Artificial Sequence: Synthetic probe
gggtgttagcgtgacgccaatggctacgcgggtacagtataatggtgtgatggttgacgc

SEQ ID NO: 21758 - DNA, 60 bp, Artificial Sequence
  Description of Artificial Sequence: Synthetic probe
cggcagcgggacgtacgctaacggaagcatatagagagtttctaaatttggctatttcaa

SEQ ID NO: 21759 - DNA, 60 bp, Artificial Sequence
  Description of Artificial Sequence: Synthetic probe
caaacggcagcgggacgtacgctaacggaagcatatagagagtttctaaatttggctatt

SEQ ID NO: 21760 - DNA, 57 bp, Artificial Sequence
  Description of Artificial Sequence: Synthetic probe
tagttcattatgaagatctcaccgcccatgctcatgccattggagcagctcaaacgg

SEQ ID NO: 21761 - DNA, 60 bp, Artificial Sequence
  Description of Artificial Sequence: Synthetic probe
tagttcattatgaagatctcaccgcccatgctcatgccattggagcagctcaaacggcag

SEQ ID NO: 21762 - DNA, 60 bp, Artificial Sequence
  Description of Artificial Sequence: Synthetic probe
ggctgttagtgttctgatcaaagaacgtgcgattcaagaaaaccacaaagaactgatgca

SEQ ID NO: 21763 - DNA, 60 bp, Artificial Sequence
  Description of Artificial Sequence: Synthetic probe
tctggctgttagtgttctgatcaaagaacgtgcgattcaagaaaaccacaaagaactgat

SEQ ID NO: 21764 - DNA, 60 bp, Artificial Sequence
  Description of Artificial Sequence: Synthetic probe
cttgagtaccgcgcaaaggagattcctgataacgctctggctgttagtgttctgatcaaa

SEQ ID NO: 21765 - DNA, 60 bp, Artificial Sequence
  Description of Artificial Sequence: Synthetic probe
gcgggatcgatttaacgcattttacgcactacgaaaatcgacctagtgttgtttcaacta

SEQ ID NO: 21766 - DNA, 60 bp, Artificial Sequence
  Description of Artificial Sequence: Synthetic probe
taagcgggatcgatttaacgcattttacgcactacgaaaatcgacctagtgttgtttcaa

SEQ ID NO: 21767 - DNA, 60 bp, Artificial Sequence
  Description of Artificial Sequence: Synthetic probe
atccaacaacatatggcattgggatgacttatcattgctacaacgagatgttacgaatgt

SEQ ID NO: 21768 - DNA, 60 bp, Artificial Sequence
  Description of Artificial Sequence: Synthetic probe
caatccaacaacatatggcattgggatgacttatcattgctacaacgagatgttacgaat

SEQ ID NO: 21769 - DNA, 60 bp, Artificial Sequence
  Description of Artificial Sequence: Synthetic probe
caatccaacaacatatggcattgggatgacttatcattgctacaacgagatgttgcgaat

SEQ ID NO: 21770 - DNA, 59 bp, Artificial Sequence
  Description of Artificial Sequence: Synthetic probe
caatccaacaacatatggcattgggatgacttatcattgctacaacgagatgttacgaa

SEQ ID NO: 21771 - DNA, 60 bp, Artificial Sequence
  Description of Artificial Sequence: Synthetic probe
cggggagatggttcatgcgtgccgctcaagcagtaactgcggtagtgtgtggtccggata

SEQ ID NO: 21772 - DNA, 60 bp, Artificial Sequence
  Description of Artificial Sequence: Synthetic probe
ccgggagatggttcatgcgtgccgctcaagcagtaactgcggtagtgtgtggtccggata

SEQ ID NO: 21773 - DNA, 60 bp, Artificial Sequence
  Description of Artificial Sequence: Synthetic probe
ccatacgaagaggatgtcgaagggaagatgaagcggtgcggggtgcaactgctcgaggat

SEQ ID NO: 21774 - DNA, 60 bp, Artificial Sequence
  Description of Artificial Sequence: Synthetic probe
cccaaccatacgaagaggatgtcgaagggaagatgaagcggtgcggggtgcaactgctcg

SEQ ID NO: 21775 - DNA, 60 bp, Artificial Sequence
  Description of Artificial Sequence: Synthetic probe
atctacacttgccgatgtttacactgttttaaggccggagtttgcgattcacggcgtaaa

SEQ ID NO: 21776 - DNA, 60 bp, Artificial Sequence
  Description of Artificial Sequence: Synthetic probe
ctgacgcggcataatttccgaaccggcatgctccaagggatcagagaggctatggctccc

SEQ ID NO: 21777 - DNA, 60 bp, Artificial Sequence
  Description of Artificial Sequence: Synthetic probe
ggtgtacgtgaactcaattttgccgtggagtgaacttgatccggaggaggagttcttacg

SEQ ID NO: 21778 - DNA, 51 bp, Artificial Sequence
  Description of Artificial Sequence: Synthetic probe
gcgatgatcgcggcaactgacgcggaggagccggcaaaggcatataaatta

SEQ ID NO: 21779 - DNA, 60 bp, Artificial Sequence
  Description of Artificial Sequence: Synthetic probe
taaacaaaactttgagagagcaatgatcgcggcaactgacgcggaggagccggcgaaggc

SEQ ID NO: 21780 - DNA, 60 bp, Artificial Sequence
  Description of Artificial Sequence: Synthetic probe
ggcaggcggtgctacaaattcacaatccgactcagcaaaatgctatggtacaaattcagg

SEQ ID NO: 21781 - DNA, 60 bp, Artificial Sequence
  Description of Artificial Sequence: Synthetic probe
gttcacccgaatcgtacttttagcgttacgacctgtgggattgtgaggcataaggtgtgt

SEQ ID NO: 21782 - DNA, 60 bp, Artificial Sequence
  Description of Artificial Sequence: Synthetic probe
cgagaggagaagcttgaagaggatattgtgtcgtgtgctgatgcgatcatgaacttttat

SEQ ID NO: 21783 - DNA, 60 bp, Artificial Sequence
  Description of Artificial Sequence: Synthetic probe
cagggtagggaaaggttagaggtgattgagaggttcttcccgaattatgggaaagcgatg

SEQ ID NO: 21784 - DNA, 60 bp, Artificial Sequence
  Description of Artificial Sequence: Synthetic probe
taagtggacgcatgccccgatgtttaatgctcgagttaaaccatgtgatatagagttggc

SEQ ID NO: 21785 - DNA, 60 bp, Artificial Sequence
  Description of Artificial Sequence: Synthetic probe
atggagtgttcgtccaacatacaagcctagagatctggaacgcgagagagagaagtacgt

SEQ ID NO: 21786 - DNA, 60 bp, Artificial Sequence
  Description of Artificial Sequence: Synthetic probe
gagtgtggtggtctaacccttacccgtgtttacgaggcgcgctaattgcggcggagtgca

SEQ ID NO: 21787 - DNA, 60 bp, Artificial Sequence
  Description of Artificial Sequence: Synthetic probe
cggtcaaattccaattcaaattagatgaaaagttctctcccaacgatccagagcgaaacg

SEQ ID NO: 21788 - DNA, 60 bp, Artificial Sequence
  Description of Artificial Sequence: Synthetic probe
gtcaggtacgacgccagttaagatacgtgatgaggttgcagcgcttgatgtgatcagaga

SEQ ID NO: 21789 - DNA, 60 bp, Artificial Sequence
  Description of Artificial Sequence: Synthetic probe
ccgagcgtaaatgttgccatgtgcgcacagaagtatggaatagtgtagtccgcaaccacc

SEQ ID NO: 21790 - DNA, 60 bp, Artificial Sequence
  Description of Artificial Sequence: Synthetic probe
cggagcaggatgagtggacgaatcatgacgttacacagataccagacaggcggatgtttg

SEQ ID NO: 21791 - DNA, 60 bp, Artificial Sequence
  Description of Artificial Sequence: Synthetic probe
gtgtggatgataccatttctcaaccaccgaggtatgccccgagtgcgccgatgccgtcat

SEQ ID NO: 21792 - DNA, 60 bp, Artificial Sequence
  Description of Artificial Sequence: Synthetic probe
cgtgtggatgataccatttctcaaccaccgaggtatgccccgagtgcgccgatgccgtca

SEQ ID NO: 21793 - DNA, 60 bp, Artificial Sequence
  Description of Artificial Sequence: Synthetic probe
ggggaagataattaaatcgctaagtagatttggaaagaaagttggaaacgcattgtcgtc

SEQ ID NO: 21794 - DNA, 60 bp, Artificial Sequence
  Description of Artificial Sequence: Synthetic probe
ggggaagataattaaatcgctaagtagatttggaaagaaagttggaagcgcattgtcgtc

SEQ ID NO: 21795 - DNA, 60 bp, Artificial Sequence
  Description of Artificial Sequence: Synthetic probe
ggggaagataattaaatcgctaagtagatttggaaagaaagttggaaatgcattgtcgtc

SEQ ID NO: 21796 - DNA, 60 bp, Artificial Sequence
  Description of Artificial Sequence: Synthetic probe
gtgcggtacgtggatacattaagtcccctgcggagtcgttagattttgttctcgggccct

SEQ ID NO: 21797 - DNA, 60 bp, Artificial Sequence
  Description of Artificial Sequence: Synthetic probe
ggtattgcgattaacagatataatggattaacgcttcgtggagttacaatgcgcccgaca

SEQ ID NO: 21798 - DNA, 60 bp, Artificial Sequence
  Description of Artificial Sequence: Synthetic probe
aggtattgcgattaataggtataatggattaacgcttcgtggagttacaatgcgcccgac

SEQ ID NO: 21799 - DNA, 60 bp, Artificial Sequence
  Description of Artificial Sequence: Synthetic probe
ttaggtattgcgattaacagatataatggattaacgcttcgtggagttacaatgcgcccg

SEQ ID NO: 21800 - DNA, 60 bp, Artificial Sequence
  Description of Artificial Sequence: Synthetic probe
gccggagctcagcgaggatgaagacgagagggcttatgctacaatgtttgaaatggttcg

SEQ ID NO: 21801 - DNA, 60 bp, Artificial Sequence
  Description of Artificial Sequence: Synthetic probe
aggccttgattacaactgcgattcacatccaccgctggattagaggctgtggcatctgga

SEQ ID NO: 21802 - DNA, 60 bp, Artificial Sequence
  Description of Artificial Sequence: Synthetic probe
cggaaagagttagactggatgattctctttccgcaatgccttacatctatgtgccaatca

SEQ ID NO: 21803 - DNA, 60 bp, Artificial Sequence
  Description of Artificial Sequence: Synthetic probe
cgctcaagatgggcacaaagctggctgcgccaactgtgtagatgtgcgaccaatctatgc

SEQ ID NO: 21804 - DNA, 60 bp, Artificial Sequence
  Description of Artificial Sequence: Synthetic probe
cccaatcgctcaagatgggcacaaagctggctgcgccaactgtgtagatgtgcgaccaat

SEQ ID NO: 21805 - DNA, 60 bp, Artificial Sequence
  Description of Artificial Sequence: Synthetic probe
gagggaatagaggataaagtgattcatccgcgtgtgatgatgaggttcaaaattcctaga

SEQ ID NO: 21806 - DNA, 60 bp, Artificial Sequence
  Description of Artificial Sequence: Synthetic probe
gagcagctagcggtaagtgttttgaataaaaagacagctgtaactgataattgcaatgag

SEQ ID NO: 21807 - DNA, 60 bp, Artificial Sequence
  Description of Artificial Sequence: Synthetic probe
gggattgatttatcgcatatgaggagtccaaagattgaacccactattatcgccacgaca

SEQ ID NO: 21808 - DNA, 60 bp, Artificial Sequence
  Description of Artificial Sequence: Synthetic probe
ggaaggagctagaagaggtgtacgacttcatgaatggcgaggcgaaagaggaggaagtgg

SEQ ID NO: 21809 - DNA, 60 bp, Artificial Sequence
  Description of Artificial Sequence: Synthetic probe
aagagtttgggaaggagctagaagaggtgtacgacttcatgaatggcgaggcgaaagagg

SEQ ID NO: 21810 - DNA, 60 bp, Artificial Sequence
  Description of Artificial Sequence: Synthetic probe
gagcagcggaatgagcttgtccgattgaaatataataaagagataacaaaagagtttggg

SEQ ID NO: 21811 - DNA, 60 bp, Artificial Sequence
  Description of Artificial Sequence: Synthetic probe
cgagcagcggaatgagcttgtccgattgaaatataataaagagataacaaaagagtttgg

SEQ ID NO: 21812 - DNA, 60 bp, Artificial Sequence
  Description of Artificial Sequence: Synthetic probe
cgaactgccattaacctgagatcagtaggtagagttgcgccccaaggtttgcaccgcatg

SEQ ID NO: 21813 - DNA, 60 bp, Artificial Sequence
  Description of Artificial Sequence: Synthetic probe
ggagagagttgaagaactaagtctggtacgcgtggatgatacaatttcacaaccaccgag

SEQ ID NO: 21814 - DNA, 60 bp, Artificial Sequence
  Description of Artificial Sequence: Synthetic probe
gtcactggcacgcgttagggatggcacaagaggccagtggacggactttaacggaggctt

SEQ ID NO: 21815 - DNA, 60 bp, Artificial Sequence
  Description of Artificial Sequence: Synthetic probe
cctcatggcgatgcgcagaaagagggtaccgaggaggagaagacgtctgaagaaccagcg

SEQ ID NO: 21816 - DNA, 60 bp, Artificial Sequence
  Description of Artificial Sequence: Synthetic probe
tctaggatcgatgcactacgatattacgtatgaagctttgaaaaacaacgcgcagagaat

SEQ ID NO: 21817 - DNA, 60 bp, Artificial Sequence
  Description of Artificial Sequence: Synthetic probe
cgtgagtttctcaatttatcaatttcaagcacatatagcagcgctatacatgcgaggcgt

SEQ ID NO: 21818 - DNA, 60 bp, Artificial Sequence
  Description of Artificial Sequence: Synthetic probe
taacggaggcgtatcgtgagtttctcaatttatcaatttcaagcacatatagcagcgcta

SEQ ID NO: 21819 - DNA, 60 bp, Artificial Sequence
  Description of Artificial Sequence: Synthetic probe
cagcggtaactgataactgcaatgagatcgcgcatatcaaacaagagatattaccaaagt

SEQ ID NO: 21820 - DNA, 60 bp, Artificial Sequence
  Description of Artificial Sequence: Synthetic probe
tttgaataaaaagacagcggtaactgataactgcaatgagatcgcgcatatcaaacaaga

SEQ ID NO: 21821 - DNA, 60 bp, Artificial Sequence
  Description of Artificial Sequence: Synthetic probe
cgcatatgaggagtccgaagattgaacccactatcatcgccacgacattggagcatcgat

SEQ ID NO: 21822 - DNA, 60 bp, Artificial Sequence
  Description of Artificial Sequence: Synthetic probe
tatcgcatatgaggagtccgaagattgaacccactatcatcgccacgacattggagcatc

SEQ ID NO: 21823 - DNA, 60 bp, Artificial Sequence
  Description of Artificial Sequence: Synthetic probe
ggcgcaggtatggccacagctgtagcgaccggtagggcgatagaaggcgcatataaattg

SEQ ID NO: 21824 - DNA, 60 bp, Artificial Sequence
  Description of Artificial Sequence: Synthetic probe
atgaccgctgacgtcttagaggcggcatcggaggaggtgccattaatcggcgcaggtatg

SEQ ID NO: 21825 - DNA, 60 bp, Artificial Sequence
  Description of Artificial Sequence: Synthetic probe
ttgccggaatgaccgctgacgtcttagaggcggcatcggaggaggtgccattaatcggcg

SEQ ID NO: 21826 - DNA, 60 bp, Artificial Sequence
  Description of Artificial Sequence: Synthetic probe
ggagcaggagatgagattccggacccgttgagtccgggagagcgcggcattcaaatgaag

SEQ ID NO: 21827 - DNA, 60 bp, Artificial Sequence
  Description of Artificial Sequence: Synthetic probe
ctagccaagaataacgcgataacggcaaacgcgagagagatccagcatattaaagaggag

SEQ ID NO: 21828 - DNA, 60 bp, Artificial Sequence
  Description of Artificial Sequence: Synthetic probe
actagccaagaataacgcgataacggcaaacgcgagagagatccagcatattaaagagga

SEQ ID NO: 21829 - DNA, 60 bp, Artificial Sequence
  Description of Artificial Sequence: Synthetic probe
gcgccgactgtgtagagatgcgacctatctgtgcactcggtagcagcagcgggaatacac

SEQ ID NO: 21830 - DNA, 60 bp, Artificial Sequence
  Description of Artificial Sequence: Synthetic probe
cgttcaatacacatacgagattgcacgacttcaggcaaacatggggcagtttcgcgcggc

SEQ ID NO: 21831 - DNA, 60 bp, Artificial Sequence
  Description of Artificial Sequence: Synthetic probe
agtgttttcgttaccagatgatatgtttaacgcattacttcccgatttaatagccggcgc

SEQ ID NO: 21832 - DNA, 60 bp, Artificial Sequence
  Description of Artificial Sequence: Synthetic probe
tttaggcacattgttatgcaagcaagggatcgagtactacgggtagacacatactatgag

SEQ ID NO: 21833 - DNA, 60 bp, Artificial Sequence
  Description of Artificial Sequence: Synthetic probe
agatggacactatcgcggcaagagcactcactgtaatgcgggcatgtgccactttacagg

SEQ ID NO: 21834 - DNA, 60 bp, Artificial Sequence
  Description of Artificial Sequence: Synthetic probe
agattaaacgacatgtaaatgaacaaattctgccaaagttgaaaagtgacctaggaggct

SEQ ID NO: 21835 - DNA, 60 bp, Artificial Sequence
  Description of Artificial Sequence: Synthetic probe
aaattaaacgacatgtaaatgaacaaattctgccaaagttgaaaagtgacctaggaggct

SEQ ID NO: 21836 - DNA, 60 bp, Artificial Sequence
  Description of Artificial Sequence: Synthetic probe
tggttgggcgacgattgatgttgagtatagagaacccgcaccctacgtacatgctcagcg

SEQ ID NO: 21837 - DNA, 60 bp, Artificial Sequence
  Description of Artificial Sequence: Synthetic probe
cgccgcttgcgcatagtccactttgcacgggtgtgggttatgtggagggtgtgtcagttg

SEQ ID NO: 21838 - DNA, 60 bp, Artificial Sequence
  Description of Artificial Sequence: Synthetic probe
cgcgccgcttacgcatagtccactttgcacgggtgtgggttatgtggagggtgtgtcagt

SEQ ID NO: 21839 - DNA, 60 bp, Artificial Sequence
  Description of Artificial Sequence: Synthetic probe
gggcaggatatcattagcctgatgttgacaccgcatggagttgaagcgacaacggaaagg

SEQ ID NO: 21840 - DNA, 60 bp, Artificial Sequence
  Description of Artificial Sequence: Synthetic probe
agaattcaggatgggcaggatatcattagcctgatgttgacaccgcatggagttgaagcg

SEQ ID NO: 21841 - DNA, 60 bp, Artificial Sequence
  Description of Artificial Sequence: Synthetic probe
taggtataatggattaacgcttcgtggagttacaatgcgcccgacatctttagctcaaag

SEQ ID NO: 21842 - DNA, 60 bp, Artificial Sequence
  Description of Artificial Sequence: Synthetic probe
gccgctcaagaggcgaaaggacgtactttgaatgaagcgtacaaggaatttttgaactta

SEQ ID NO: 21843 - DNA, 52 bp, Artificial Sequence
  Description of Artificial Sequence: Synthetic probe
gccgctcaagaggcgaaaggacgtactttgaatgaagcgtacaaggaatttt

SEQ ID NO: 21844 - DNA, 60 bp, Artificial Sequence
  Description of Artificial Sequence: Synthetic probe
gatataccagataaagaattagctgtaagtatcctggcaaagaataatgcgatcgtagcg

SEQ ID NO: 21845 - DNA, 60 bp, Artificial Sequence
  Description of Artificial Sequence: Synthetic probe
taaatgcgttaagcggaatagatctttcgcacttacgaaccccgaagatagagccgacga

SEQ ID NO: 21846 - DNA, 60 bp, Artificial Sequence
  Description of Artificial Sequence: Synthetic probe
ataaatgcgttaagcggaatagatctttcgcacttacgaaccccgaagatagagccgacg

SEQ ID NO: 21847 - DNA, 60 bp, Artificial Sequence
  Description of Artificial Sequence: Synthetic probe
gacgtattggaagcagcttctgaagaggtaccgttagtgggttcaggaatggcgacggcc

SEQ ID NO: 21848 - DNA, 60 bp, Artificial Sequence
  Description of Artificial Sequence: Synthetic probe
ggagagggatgggatgcaagaggaagccatccaggagatcgcgggtatgacagctgacgt

SEQ ID NO: 21849 - DNA, 60 bp, Artificial Sequence
  Description of Artificial Sequence: Synthetic probe
caatcgaagtggagagggatgggatgcaagaggaagccatccaggagatcgcgggtatga

SEQ ID NO: 21850 - DNA, 60 bp, Artificial Sequence
  Description of Artificial Sequence: Synthetic probe
atgtactaggagcaggggatgagattccagacccgttgagtccgggtgagcgcggcattc

SEQ ID NO: 21851 - DNA, 60 bp, Artificial Sequence
  Description of Artificial Sequence: Synthetic probe
aggcagtactgttgaatgtactaggagcaggggatgagattccagacccgttgagtccgg

SEQ ID NO: 21852 - DNA, 55 bp, Artificial Sequence
  Description of Artificial Sequence: Synthetic probe
cgtatgttacggatatgcgccacgcgcagatggaacaatgccggactggaataac

SEQ ID NO: 21853 - DNA, 54 bp, Artificial Sequence
  Description of Artificial Sequence: Synthetic probe
cgtatgttacggatatgcgccacgcgcagatggaacaatgccggactggaataa

SEQ ID NO: 21854 - DNA, 60 bp, Artificial Sequence
  Description of Artificial Sequence: Synthetic probe
gcaacgtagcgcgttgcttagactcttctgcttcgtatgttacggatatgcgccacgcgc

SEQ ID NO: 21855 - DNA, 60 bp, Artificial Sequence
  Description of Artificial Sequence: Synthetic probe
agaacggttaagatcgaagagcatgtgggtaatgattcagtgttcaagacaaagctggtt

SEQ ID NO: 21856 - DNA, 60 bp, Artificial Sequence
  Description of Artificial Sequence: Synthetic probe
acacaatcagataaaacgggaagtagagaggcaaattaatacatgtccttattcaggcta

SEQ ID NO: 21857 - DNA, 60 bp, Artificial Sequence
  Description of Artificial Sequence: Synthetic probe
caacataatcagataaaacgggaagtagagaggcaaattaatacatgtccttattcaggc

SEQ ID NO: 21858 - DNA, 60 bp, Artificial Sequence
  Description of Artificial Sequence: Synthetic probe
gcaacataatcagataaaacgggaagtagagaggcaaattaatacatgtccttattcagg

SEQ ID NO: 21859 - DNA, 60 bp, Artificial Sequence
  Description of Artificial Sequence: Synthetic probe
gctgtcagcaatgccatacatctatgtaccaatcagagaaggccaaatcgttaatccaac

SEQ ID NO: 21860 - DNA, 60 bp, Artificial Sequence
  Description of Artificial Sequence: Synthetic probe
cgctgtcagcaatgccatacatctatgtaccaatcagagaaggccaaatcgttaatccaa

SEQ ID NO: 21861 - DNA, 60 bp, Artificial Sequence
  Description of Artificial Sequence: Synthetic probe
gctgccgccaatcttcccaccaaatgaccgagatagtatcttaacccttttacttttatc

SEQ ID NO: 21862 - DNA, 60 bp, Artificial Sequence
  Description of Artificial Sequence: Synthetic probe
atgctgccgccaatcttcccaccaaatgaccgagatagtatcttaacccttttactttta

SEQ ID NO: 21863 - DNA, 60 bp, Artificial Sequence
  Description of Artificial Sequence: Synthetic probe
gtggtccggatatgattcaggtgtcactaaacgctggggcgagaggggatgtacaacaga

SEQ ID NO: 21864 - DNA, 60 bp, Artificial Sequence
  Description of Artificial Sequence: Synthetic probe
tgtgtggtccggatatgattcaggtgtcactaaacgctggggcgagaggggatgtacaac

SEQ ID NO: 21865 - DNA, 60 bp, Artificial Sequence
  Description of Artificial Sequence: Synthetic probe
cctggaagatggtttatgcgcgccgctcaagcagtgactgcagtagtgtgtggtccggat

SEQ ID NO: 21866 - DNA, 60 bp, Artificial Sequence
  Description of Artificial Sequence: Synthetic probe
tcaacctggaagatggtttatgcgcgccgctcaagcagtgactgcagtagtgtgtggtcc

SEQ ID NO: 21867 - DNA, 50 bp, Artificial Sequence
  Description of Artificial Sequence: Synthetic probe
ttttccttgaaactgaggagacctttcaacctggaagatggtttatgcgc

SEQ ID NO: 21868 - DNA, 52 bp, Artificial Sequence
  Description of Artificial Sequence: Synthetic probe
cggaagcggcgaatgaaatagcacgtgtgactggggagacttcgacgtgggg

SEQ ID NO: 21869 - DNA, 60 bp, Artificial Sequence
  Description of Artificial Sequence: Synthetic probe
atgcgagcatgcgctacgcttcaagaggcgagaattgtgttggaagccaatgtgatggaa

SEQ ID NO: 21870 - DNA, 60 bp, Artificial Sequence
  Description of Artificial Sequence: Synthetic probe
gatgatgtaagattgagacagatcaaacgccatgtgaatgagcagattttaccaaaatta

SEQ ID NO: 21871 - DNA, 60 bp, Artificial Sequence
  Description of Artificial Sequence: Synthetic probe
gggcttatgctacgatgtttgaaatggttcgatgcattatcactctatgctatgcagaga

SEQ ID NO: 21872 - DNA, 53 bp, Artificial Sequence
  Description of Artificial Sequence: Synthetic probe
ccagatgatgtgctgcaaggtctaccctttagttatgatactaacgaaagagg

SEQ ID NO: 21873 - DNA, 60 bp, Artificial Sequence
  Description of Artificial Sequence: Synthetic probe
cccgatttaatagctggcgctcatcagaatgcagaccctgtcgtcctagatgtaagctgg

SEQ ID NO: 21874 - DNA, 60 bp, Artificial Sequence
  Description of Artificial Sequence: Synthetic probe
gcgttactccccgatttaatagctggcgctcatcagaatgcagaccctgtcgtcctagat

SEQ ID NO: 21875 - DNA, 60 bp, Artificial Sequence
  Description of Artificial Sequence: Synthetic probe
ctggtcgccgcaggtaaagattcggaggcggcgtacttccgcagtatgttacccttccac

SEQ ID NO: 21876 - DNA, 60 bp, Artificial Sequence
  Description of Artificial Sequence: Synthetic probe
ccagcagtgagaatggttgcgggcgttgtaggccatctacttttcacggcgggaggacga

SEQ ID NO: 21877 - DNA, 60 bp, Artificial Sequence
  Description of Artificial Sequence: Synthetic probe
ccaggacaaattatacttgatctcaagattgatcctggtgaaaggatggatccagcagtg

SEQ ID NO: 21878 - DNA, 53 bp, Artificial Sequence
  Description of Artificial Sequence: Synthetic probe
ccaaagaaatgatcccaggacctagcaggttggaaaaactacgtgaagcgaga

SEQ ID NO: 21879 - DNA, 60 bp, Artificial Sequence
  Description of Artificial Sequence: Synthetic probe
gatcaagaatgaacgagagtctgcgccacggctacaggttcaaaacgtggcgccaaagga

SEQ ID NO: 21880 - DNA, 60 bp, Artificial Sequence
  Description of Artificial Sequence: Synthetic probe
cgagctacggcaaaagatcaagaatgaacgagagtctgcgccacggctacaggttcaaaa

SEQ ID NO: 21881 - DNA, 60 bp, Artificial Sequence
  Description of Artificial Sequence: Synthetic probe
gtgaaatgcctgatctaccaggtgtgatgagatcaaactacgatgttcgcgagctacggc

SEQ ID NO: 21882 - DNA, 60 bp, Artificial Sequence
  Description of Artificial Sequence: Synthetic probe
agtgaaatgcctgatctaccaggtgtgatgagatcaaactacgatgttcgcgagctacgg

SEQ ID NO: 21883 - DNA, 60 bp, Artificial Sequence
  Description of Artificial Sequence: Synthetic probe
cggaaagatgggaggagtggaaatttgagggtgtaagcgtgacgccactggctactcggg

SEQ ID NO: 21884 - DNA, 60 bp, Artificial Sequence
  Description of Artificial Sequence: Synthetic probe
atccggaacctaaagggtacgtgctgaacgttccaggacctggtgcatacagaattcagg

SEQ ID NO: 21885 - DNA, 60 bp, Artificial Sequence
  Description of Artificial Sequence: Synthetic probe
ttgcgattaacaggtataatggattaacgcttcgtggagttacaatgcgcccgacgtctt

SEQ ID NO: 21886 - DNA, 60 bp, Artificial Sequence
  Description of Artificial Sequence: Synthetic probe
cgcgatggcattggttagcaacgaagatttacagatgcatgtactgcgcggccctgtgca

SEQ ID NO: 21887 - DNA, 60 bp, Artificial Sequence
  Description of Artificial Sequence: Synthetic probe
ctttccgcgaggcgtatagggaatttttcatgcttgcatcgaatgtggctggacaagggg

SEQ ID NO: 21888 - DNA, 59 bp, Artificial Sequence
  Description of Artificial Sequence: Synthetic probe
attgaatacgttttttatgaggatctgactcagcactggcacgcgttgggggcggcgca

SEQ ID NO: 21889 - DNA, 60 bp, Artificial Sequence
  Description of Artificial Sequence: Synthetic probe
cgttttaagataccacaggcccaaaggccttcaatgcatatatatgcggcgccctgggat

SEQ ID NO: 21890 - DNA, 60 bp, Artificial Sequence
  Description of Artificial Sequence: Synthetic probe
tgtgataagcgctctgtctggaattgacttaacccatctgagtgtgcctaaggtccagcc

SEQ ID NO: 21891 - DNA, 60 bp, Artificial Sequence
  Description of Artificial Sequence: Synthetic probe
ggtcgagaaagaggggttacaggaggaagcaatccaagaaattgctggtatgagcgcgga

SEQ ID NO: 21892 - DNA, 60 bp, Artificial Sequence
  Description of Artificial Sequence: Synthetic probe
gaagtcttatgtgggcgtctttaaggcggaaaatgagagcattaataaactcaaacaggc

SEQ ID NO: 21893 - DNA, 60 bp, Artificial Sequence
  Description of Artificial Sequence: Synthetic probe
attgaatgttttaggaggaggcgacacgatagctgacccgctgagcccaggtgagaatga

SEQ ID NO: 21894 - DNA, 60 bp, Artificial Sequence
  Description of Artificial Sequence: Synthetic probe
tcgacggattaatacagggaagtgtacattcaatcatgacaggagagtcgtatggcgaga

SEQ ID NO: 21895 - DNA, 60 bp, Artificial Sequence
  Description of Artificial Sequence: Synthetic probe
cggaaatgcagctgaaagattcgccgaaagtgagattggaagcgcggcgatcgacggatt

SEQ ID NO: 21896 - DNA, 60 bp, Artificial Sequence
  Description of Artificial Sequence: Synthetic probe
gtatagttacacatcgtttatgcaagaaaaatgtactcgggttcacttgccagattctac

SEQ ID NO: 21897 - DNA, 60 bp, Artificial Sequence
  Description of Artificial Sequence: Synthetic probe
tttctgacgataggatcgatgcagcccacaggtgcaaccggcttcgcgcgagattcccct

SEQ ID NO: 21898 - DNA, 60 bp, Artificial Sequence
  Description of Artificial Sequence: Synthetic probe
atctagacacaaccattttctcaggtggcgtgcaacgaagcgtcgtctctaccaaacaga

SEQ ID NO: 21899 - DNA, 60 bp, Artificial Sequence
  Description of Artificial Sequence: Synthetic probe
ggtttctcccggtggaggtaggagcattctataatcgatttggcgttacatcgttcttag

SEQ ID NO: 21900 - DNA, 60 bp, Artificial Sequence
  Description of Artificial Sequence: Synthetic probe
gttacgactcttatgaatcctgcgaaagttaaggatgttatggttatcaacttcctccca

SEQ ID NO: 21901 - DNA, 60 bp, Artificial Sequence
  Description of Artificial Sequence: Synthetic probe
cgctcaactgtcggtgcttcttatagattttctgtatgaaagacgacgtacggtgcgaga

SEQ ID NO: 21902 - DNA, 60 bp, Artificial Sequence
  Description of Artificial Sequence: Synthetic probe
aacagctctattctggattgatgttatggagaagcatgtcggggacgctgaagatagcat

SEQ ID NO: 21903 - DNA, 60 bp, Artificial Sequence
  Description of Artificial Sequence: Synthetic probe
caggccaagagcgatgatccggacatagtgagaaccttagcgcccattggctcagatccg

SEQ ID NO: 21904 - DNA, 60 bp, Artificial Sequence
  Description of Artificial Sequence: Synthetic probe
catgtgacttgaacccagacgtggatggcatcattacaaagtttaacaagactgcctata

SEQ ID NO: 21905 - DNA, 60 bp, Artificial Sequence
  Description of Artificial Sequence: Synthetic probe
tataacagccgtatctggtggacaaaaccatacccatgtttacgtggcgcactgatcgcg

SEQ ID NO: 21906 - DNA, 60 bp, Artificial Sequence
  Description of Artificial Sequence: Synthetic probe
ttgctatcgggtataggtaagaagatggtttgcatagaagaagagccaaagaatgagagt

SEQ ID NO: 21907 - DNA, 60 bp, Artificial Sequence
  Description of Artificial Sequence: Synthetic probe
gaaaacgttgggcggattaaccaggttgcgtgtacaggggaaaataccgcctctgataca

SEQ ID NO: 21908 - DNA, 60 bp, Artificial Sequence
  Description of Artificial Sequence: Synthetic probe
cacattgagccaatatgtgagaaagacaaagcgtgcgaccatacgcgtgtttccatgtgg

SEQ ID NO: 21909 - DNA, 60 bp, Artificial Sequence
  Description of Artificial Sequence: Synthetic probe
ctcaatggatgtgcagccactaaaggttagcttaggcctgccaccaacaattagacatga

SEQ ID NO: 21910 - DNA, 60 bp, Artificial Sequence
  Description of Artificial Sequence: Synthetic probe
catttcccaaaagagacgttagtagagtatgattgtatcatcgagctaaatccgccagtt

SEQ ID NO: 21911 - DNA, 60 bp, Artificial Sequence
  Description of Artificial Sequence: Synthetic probe
aagactatacaccctaaagttatgatgaaatttaagattccgagagcacagcagccacag

SEQ ID NO: 21912 - DNA, 60 bp, Artificial Sequence
  Description of Artificial Sequence: Synthetic probe
gaaaatacaatatcagtggggattacgcaaatgccacgagaacttttttggctatttcac

SEQ ID NO: 21913 - DNA, 60 bp, Artificial Sequence
  Description of Artificial Sequence: Synthetic probe
gatcgaaatgaaatgcccgatttgccaggcgtgatgagatcaaattatgatatccgcgaa

SEQ ID NO: 21914 - DNA, 60 bp, Artificial Sequence
  Description of Artificial Sequence: Synthetic probe
gcggaatgattttgatcgaaatgaaatgcccgatttgccaggcgtgatgagatcaaatta

SEQ ID NO: 21915 - DNA, 60 bp, Artificial Sequence
  Description of Artificial Sequence: Synthetic probe
gcgacaacggaaagatgggaagagtggaaatttgagggtgttagcgtgacgccaatggct

SEQ ID NO: 21916 - DNA, 60 bp, Artificial Sequence
  Description of Artificial Sequence: Synthetic probe
cagctaccggtcaatccacaggtagtgtgggatgtgccgcgcagctctatcgccaactta

SEQ ID NO: 21917 - DNA, 56 bp, Artificial Sequence
  Description of Artificial Sequence: Synthetic probe
aaaagcggagaaggctgcattcgcatcgtacgcggaagcgtttcgtgatgatgtga

SEQ ID NO: 21918 - DNA, 60 bp, Artificial Sequence
  Description of Artificial Sequence: Synthetic probe
aaaagcggagaaggctgcattcgcatcgtacgcggaagcgtttcgtgatgatgtgaggtt

SEQ ID NO: 21919 - DNA, 54 bp, Artificial Sequence
  Description of Artificial Sequence: Synthetic probe
aaaagcggagaaggctgcattcgcatcgtacgcggaagcgtttcgtgatgatgt

SEQ ID NO: 21920 - DNA, 60 bp, Artificial Sequence
  Description of Artificial Sequence: Synthetic probe
tagttcactatgaggacctgaccgcgcattggcacgctttaggggcagctcaaacagcgg

SEQ ID NO: 21921 - DNA, 60 bp, Artificial Sequence
  Description of Artificial Sequence: Synthetic probe
ggcggctgaacggtttgcagaaagtgaaatcgggtccgcagcgatagatggcttagtgca

SEQ ID NO: 21922 - DNA, 60 bp, Artificial Sequence
  Description of Artificial Sequence: Synthetic probe
cacagatgaggaaaggttttatgccttgttgctgatatgtgcaacggatgcgtactcacg

SEQ ID NO: 21923 - DNA, 60 bp, Artificial Sequence
  Description of Artificial Sequence: Synthetic probe
ggtcgcacagatgaggaaaggttttatgccttgttgctgatatgtgcaacggatgcgtac

SEQ ID NO: 21924 - DNA, 60 bp, Artificial Sequence
  Description of Artificial Sequence: Synthetic probe
ggtcacacatatgatgaaacgttacatgccttgttgctgatatgtgcaacggatgcgtac

SEQ ID NO: 21925 - DNA, 60 bp, Artificial Sequence
  Description of Artificial Sequence: Synthetic probe
ctccgagaatacagagaaaaccaatatcatgcaaaacacgagtggtcgcacagatgagga

SEQ ID NO: 21926 - DNA, 60 bp, Artificial Sequence
  Description of Artificial Sequence: Synthetic probe
tctccgagaatacagagaaaaccaatatcatgcaaaacacgagtggtcacacatatgatg

SEQ ID NO: 21927 - DNA, 60 bp, Artificial Sequence
  Description of Artificial Sequence: Synthetic probe
tgttcttctccgagaatacagagaaaaccaatatcatgcaaaacacgagtggtcgcacag

SEQ ID NO: 21928 - DNA, 60 bp, Artificial Sequence
  Description of Artificial Sequence: Synthetic probe
gtggtgagataccgaatgacatacgcgttgagatggaacggctaaaccaaatccgtgcca

SEQ ID NO: 21929 - DNA, 60 bp, Artificial Sequence
  Description of Artificial Sequence: Synthetic probe
ctgattacggtaagtggtgagataccgaatgacatacgcgttgagatggaaccgctaaac

SEQ ID NO: 21930 - DNA, 60 bp, Artificial Sequence
  Description of Artificial Sequence: Synthetic probe
agaagtgggatgttactgattacggtaagtggtgagataccgaatgacatacgcgttgag

SEQ ID NO: 21931 - DNA, 57 bp, Artificial Sequence
  Description of Artificial Sequence: Synthetic probe
ttttaaaggtgggatgttacagattacggtaagtggtgagataccgaatgacatacg

SEQ ID NO: 21932 - DNA, 60 bp, Artificial Sequence
  Description of Artificial Sequence: Synthetic probe
cacagagggaaaggatcgatgaaccattcgagccgggtaggccgaaggtaggtagcttgg

SEQ ID NO: 21933 - DNA, 60 bp, Artificial Sequence
  Description of Artificial Sequence: Synthetic probe
ctacgagtgcattcacagagggaaaggatcgatgaaccattcgagccaggtaggccgaag

SEQ ID NO: 21934 - DNA, 60 bp, Artificial Sequence
  Description of Artificial Sequence: Synthetic probe
ttctacgagtgcactcacagagggaaaggatcgatgaaccattcgagccgggtaggccga

SEQ ID NO: 21935 - DNA, 60 bp, Artificial Sequence
  Description of Artificial Sequence: Synthetic probe
aacgatacgtacgtgctacgagtgcactcacagagggaaaggatcgatgaaccattcgag

SEQ ID NO: 21936 - DNA, 60 bp, Artificial Sequence
  Description of Artificial Sequence: Synthetic probe
gtcatcgaaaaggtatgagttgcagtgtgtaggtgcgtgcgagcgtgttgcttttgtctc

SEQ ID NO: 21937 - DNA, 60 bp, Artificial Sequence
  Description of Artificial Sequence: Synthetic probe
gcaattcatggtgtgaatgctatgccgggtccgcttacgcgggcgattgctcgtgccgct

SEQ ID NO: 21938 - DNA, 60 bp, Artificial Sequence
  Description of Artificial Sequence: Synthetic probe
tgtccactctcgcagatgtttacacagtattgaaaccagaatttgcaattcatggtgtga

SEQ ID NO: 21939 - DNA, 60 bp, Artificial Sequence
  Description of Artificial Sequence: Synthetic probe
tgctattgtccactctcgcagatgtttacacagtattgaaaccagaatttgcaattcatg

SEQ ID NO: 21940 - DNA, 60 bp, Artificial Sequence
  Description of Artificial Sequence: Synthetic probe
tccgccgaatgacagagagagtatacttacaattttgctattgtccactctcgcagatgt

SEQ ID NO: 21941 - DNA, 60 bp, Artificial Sequence
  Description of Artificial Sequence: Synthetic probe
ggcatggattaagaacagcaattttgaacagaacgacgttaccaaatatgctgccaccga

SEQ ID NO: 21942 - DNA, 60 bp, Artificial Sequence
  Description of Artificial Sequence: Synthetic probe
tggcatggattaagaacagcaattttgaacagaacgacgttaccaaatatgctgccaccg

SEQ ID NO: 21943 - DNA, 60 bp, Artificial Sequence
  Description of Artificial Sequence: Synthetic probe
gtcgcattttatgtatcgatggataagacattaaaccaattcccctcgctcgcagcagag

SEQ ID NO: 21944 - DNA, 60 bp, Artificial Sequence
  Description of Artificial Sequence: Synthetic probe
gctccaagtcgcattttatgtatcgatggataagacattaaaccaattcccctcgctcgc

SEQ ID NO: 21945 - DNA, 60 bp, Artificial Sequence
  Description of Artificial Sequence: Synthetic probe
gccgcactacaagttcataacccaactcaacagaatgcgatgatccagctccaagtcgca

SEQ ID NO: 21946 - DNA, 60 bp, Artificial Sequence
  Description of Artificial Sequence: Synthetic probe
caagccgcactacaagttcataacccaactcaacagaatgcgatgatccagctccaagtc

SEQ ID NO: 21947 - DNA, 60 bp, Artificial Sequence
  Description of Artificial Sequence: Synthetic probe
acatgcgggcgggtcggataatcgcgtgggatggccaagccgcactacaagttcataacc

SEQ ID NO: 21948 - DNA, 60 bp, Artificial Sequence
  Description of Artificial Sequence: Synthetic probe
taattcacagcaaacaatggctggtgtgaccgtaagtgtgggcggagtcgacatgcgggc

SEQ ID NO: 21949 - DNA, 60 bp, Artificial Sequence
  Description of Artificial Sequence: Synthetic probe
tgccatgccgcaaggtaattcacagcaaacaatggctggtgtgaccgtaagtgtgggcgg

SEQ ID NO: 21950 - DNA, 60 bp, Artificial Sequence
  Description of Artificial Sequence: Synthetic probe
ggtgagtggatcagacacggttcaagtgtctttgaacgcaggtgcccggggtgatataca

SEQ ID NO: 21951 - DNA, 60 bp, Artificial Sequence
  Description of Artificial Sequence: Synthetic probe
atggtttcttccttgagactgaggaaacgtttcaacctgggaggtggttcatgcgggcgg

SEQ ID NO: 21952 - DNA, 60 bp, Artificial Sequence
  Description of Artificial Sequence: Synthetic probe
cagcgcgtcagccttatggtttcttccttgagactgaggaaacgtttcaacctgggaggt

SEQ ID NO: 21953 - DNA, 60 bp, Artificial Sequence
  Description of Artificial Sequence: Synthetic probe
agcgcgtgtgactggcgagacgacaacatggggaccagcgcgtcagccttatggtttctt

SEQ ID NO: 21954 - DNA, 60 bp, Artificial Sequence
  Description of Artificial Sequence: Synthetic probe
gaccaatttcgccggattatgtgcaacatatggcaacaatcggagtgttggctactccgg

SEQ ID NO: 21955 - DNA, 60 bp, Artificial Sequence
  Description of Artificial Sequence: Synthetic probe
agggattaatgtgggaccaatttcgccggattatgtgcaacatatggcaacaatcggagt

SEQ ID NO: 21956 - DNA, 60 bp, Artificial Sequence
  Description of Artificial Sequence: Synthetic probe
gatataatgggttgactttacgtggtgtaactatgcggccgacttcgcttgctcagagga

SEQ ID NO: 21957 - DNA, 60 bp, Artificial Sequence
  Description of Artificial Sequence: Synthetic probe
gaatcgcaattaatagatataatgggttgactttacgtggtgtaactatgcggccgactt

SEQ ID NO: 21958 - DNA, 60 bp, Artificial Sequence
  Description of Artificial Sequence: Synthetic probe
cagcgagggcgctaaccgtaatgcgggcatgttcgaccctgcaagaggctaggatcgtat

SEQ ID NO: 21959 - DNA, 60 bp, Artificial Sequence
  Description of Artificial Sequence: Synthetic probe
atggacactatcgcagcgagggcgctaaccgtaatgcgggcatgttcgaccctgcaagag

SEQ ID NO: 21960 - DNA, 60 bp, Artificial Sequence
  Description of Artificial Sequence: Synthetic probe
cagggttgttacgtaccacaggatcgtatgatgattatctcatcagaaaggaggaaggat

SEQ ID NO: 21961 - DNA, 60 bp, Artificial Sequence
  Description of Artificial Sequence: Synthetic probe
ataaaggaagctgcttcgagcgtgggcagattggagaggttgcgtgaggcaagaactaat

SEQ ID NO: 21962 - DNA, 60 bp, Artificial Sequence
  Description of Artificial Sequence: Synthetic probe
gagataaaggaagctgcttcgagcgtgggcagattggagaggttgcgtgaggcaagaact

SEQ ID NO: 21963 - DNA, 60 bp, Artificial Sequence
  Description of Artificial Sequence: Synthetic probe
ggatggacgaagatgaagcgagggtcgacgaagagataaaggaagctgcttcgagcgtgg

SEQ ID NO: 21964 - DNA, 60 bp, Artificial Sequence
  Description of Artificial Sequence: Synthetic probe
ggagtcgcgttggatggacgaagatgaagcgagggtcaacgaagagataaaggaagctgc

SEQ ID NO: 21965 - DNA, 60 bp, Artificial Sequence
  Description of Artificial Sequence: Synthetic probe
gggaggagtcgcgttggatggacgaagatgaagcgagggtcgacgaagagataaaggaag

SEQ ID NO: 21966 - DNA, 60 bp, Artificial Sequence
  Description of Artificial Sequence: Synthetic probe
caagggaggagtcgcgttggatggacgaagatgaagcgagggtcaacgaagagataaagg

SEQ ID NO: 21967 - DNA, 60 bp, Artificial Sequence
  Description of Artificial Sequence: Synthetic probe
gctcccgtcgctgcagccatcattaaaactcgtgttggaagaggaagcatgggccgctgc

SEQ ID NO: 21968 - DNA, 60 bp, Artificial Sequence
  Description of Artificial Sequence: Synthetic probe
tgagcccacgcataggaatgagatgctcgagatcgctccgttgatcgaatctgtttatgc

SEQ ID NO: 21969 - DNA, 60 bp, Artificial Sequence
  Description of Artificial Sequence: Synthetic probe
tttcaacagatcatttgagcccacgcataggaatgagatgctcgagatcgctccgttgat

SEQ ID NO: 21970 - DNA, 60 bp, Artificial Sequence
  Description of Artificial Sequence: Synthetic probe
aacgccgacccagtcgtactagatgtgagttggatatcgctgtggtttgctttcaacaga

SEQ ID NO: 21971 - DNA, 60 bp, Artificial Sequence
  Description of Artificial Sequence: Synthetic probe
gcagggaaagattctgaggcggcgtattttcgcagtatgctaccttttcatatggtgagg

SEQ ID NO: 21972 - DNA, 60 bp, Artificial Sequence
  Description of Artificial Sequence: Synthetic probe
gttgctgcagggaaagattctgaggcggcgtattttcgcagtatgctaccttttcatatg

SEQ ID NO: 21973 - DNA, 60 bp, Artificial Sequence
  Description of Artificial Sequence: Synthetic probe
tctacttagcgctaatgtttcctggacagatcatacttgatctgaaaattgatcccggtg

SEQ ID NO: 21974 - DNA, 60 bp, Artificial Sequence
  Description of Artificial Sequence: Synthetic probe
ccaacttaatcatgaatatagcaacatgtttacctacaggagaatatatcgcaccaaatc

SEQ ID NO: 21975 - DNA, 52 bp, Artificial Sequence
  Description of Artificial Sequence: Synthetic probe
ccagatgtacaaaagattctagatgacatcaaagcattagccgcggagcagg

SEQ ID NO: 21976 - DNA, 60 bp, Artificial Sequence
  Description of Artificial Sequence: Synthetic probe
gcttgaggattaccgcaaaagtgggatgatggatgaggccgtgaagcaatccgcattggt

SEQ ID NO: 21977 - DNA, 60 bp, Artificial Sequence
  Description of Artificial Sequence: Synthetic probe
caactgcttgaggattaccgcaaaagtgggatgatggatgaggccgtgaagcaatccgca

SEQ ID NO: 21978 - DNA, 60 bp, Artificial Sequence
  Description of Artificial Sequence: Synthetic probe
cgctagatggtttcgaattaccattaacctgagatcagtaggtagagtggcgccccgagg

SEQ ID NO: 21979 - DNA, 60 bp, Artificial Sequence
  Description of Artificial Sequence: Synthetic probe
gcagatcccgacctgtggtgtgattgatgtacgcgcatcggagctaactgggtgttcgcc

SEQ ID NO: 21980 - DNA, 60 bp, Artificial Sequence
  Description of Artificial Sequence: Synthetic probe
gaagcgagcgatcatacacactactctattggtagcagctgtggttgcgctgctgacatc

SEQ ID NO: 21981 - DNA, 60 bp, Artificial Sequence
  Description of Artificial Sequence: Synthetic probe
gatatgcgacatctttcgttgatgcagaggagattcccagatgttttaatccaagcgaga

SEQ ID NO: 21982 - DNA, 53 bp, Artificial Sequence
  Description of Artificial Sequence: Synthetic probe
gagagaagcttgaaccagcaaattgacatgattaagaaggaagtgatgaagaa

SEQ ID NO: 21983 - DNA, 60 bp, Artificial Sequence
  Description of Artificial Sequence: Synthetic probe
gttggggatttcgcgtgagggagtggccgagcagacagagagattgagggacctgcggcg

SEQ ID NO: 21984 - DNA, 60 bp, Artificial Sequence
  Description of Artificial Sequence: Synthetic probe
cccaggacagattatacttgatctaaagattgaccccggcgagaggatggatccagcagt

SEQ ID NO: 21985 - DNA, 60 bp, Artificial Sequence
  Description of Artificial Sequence: Synthetic probe
tacatcagctgagatacctcaatggtttaaaagtttgaatccaatgttgggtgtggtgaa

SEQ ID NO: 21986 - DNA, 60 bp, Artificial Sequence
  Description of Artificial Sequence: Synthetic probe
cgatatgttcaacgcattattacccgacctaattgctggggcgcatcagaacgccgaccc

SEQ ID NO: 21987 - DNA, 60 bp, Artificial Sequence
  Description of Artificial Sequence: Synthetic probe
cacgccggactctcttgttttgattaatccaacgtatacgatgactaaagtctttatcaa

SEQ ID NO: 21988 - DNA, 60 bp, Artificial Sequence
  Description of Artificial Sequence: Synthetic probe
acgaacagttcgcgttaaattttatgatgcgcgacccccggatgatgttttgcagggttt

SEQ ID NO: 21989 - DNA, 60 bp, Artificial Sequence
  Description of Artificial Sequence: Synthetic probe
ggcattagaagaagaagcttgggctgcggcgaatgactttgaggatttgatgctgactga

SEQ ID NO: 21990 - DNA, 60 bp, Artificial Sequence
  Description of Artificial Sequence: Synthetic probe
cgtcgcttaaactggcattagaagaagaagcttgggctgcggcgaatgactttgaggatt

SEQ ID NO: 21991 - DNA, 60 bp, Artificial Sequence
  Description of Artificial Sequence: Synthetic probe
gagatatgatgagatgggttatgctaccttcgttacaaccgtcgcttaaactggcattag

SEQ ID NO: 21992 - DNA, 60 bp, Artificial Sequence
  Description of Artificial Sequence: Synthetic probe
agccccgaagcagtcaaggccgtgatgaacttatcacactcacataatttcatcaatata

SEQ ID NO: 21993 - DNA, 60 bp, Artificial Sequence
  Description of Artificial Sequence: Synthetic probe
tcctaattcaagcaagaccgtctcacttctggaaggcagtattaaatgatagccccgaag

SEQ ID NO: 21994 - DNA, 60 bp, Artificial Sequence
  Description of Artificial Sequence: Synthetic probe
gcggatcctgtcgttttggatgtaagttggatttcgctttggtttgcctttaatcgatcg

SEQ ID NO: 21995 - DNA, 60 bp, Artificial Sequence
  Description of Artificial Sequence: Synthetic probe
gttcaacgcgttgcttcccgatttaatagccggcgttcatcagaatgcggatcctgtcgt

SEQ ID NO: 21996 - DNA, 60 bp, Artificial Sequence
  Description of Artificial Sequence: Synthetic probe
attggcaggaatcagtatgattgcaacgtttttcgagcagattttgcgacgggaacagga

SEQ ID NO: 21997 - DNA, 60 bp, Artificial Sequence
  Description of Artificial Sequence: Synthetic probe
cggcgggaggaagatttactaacttaactcagaatatggctcgtcaattggacattgcgt

SEQ ID NO: 21998 - DNA, 60 bp, Artificial Sequence
  Description of Artificial Sequence: Synthetic probe
aagaggcgagcgggcgtacgttaacggaggcgtatcgtgaatttctcaatctatcgattt

SEQ ID NO: 21999 - DNA, 60 bp, Artificial Sequence
  Description of Artificial Sequence: Synthetic probe
tttcccaaccgccgagatatgccccgagtgcgcccatgccatcgtcgatgcctactgttg

SEQ ID NO: 22000 - DNA, 60 bp, Artificial Sequence
  Description of Artificial Sequence: Synthetic probe
tggtttaagagtttgaatccaatgttgggtgtggtgaatttgggagctaccttcctgatg

SEQ ID NO: 22001 - DNA, 60 bp, Artificial Sequence
  Description of Artificial Sequence: Synthetic probe
gatggtgcgatgcatcattactctgtgttatgccgagaaggttcactttgctggattcac

SEQ ID NO: 22002 - DNA, 60 bp, Artificial Sequence
  Description of Artificial Sequence: Synthetic probe
gctactatgtttgagatggtgcgatgcatcattactctgtgttatgccgagaaggttcac

SEQ ID NO: 22003 - DNA, 60 bp, Artificial Sequence
  Description of Artificial Sequence: Synthetic probe
gccactatgtttgagatggtgcgatgcatcattactctgtgttatgccgagaaggttcac

SEQ ID NO: 22004 - DNA, 52 bp, Artificial Sequence
  Description of Artificial Sequence: Synthetic probe
agaacggttaagatcgaagagcatgtgggtaatgattcagtgttcaagacaa

SEQ ID NO: 22005 - DNA, 60 bp, Artificial Sequence
  Description of Artificial Sequence: Synthetic probe
ggaccaaccggagagatgggagtggcttctagattatatggacagaaagcatacgtgtca

SEQ ID NO: 22006 - DNA, 60 bp, Artificial Sequence
  Description of Artificial Sequence: Synthetic probe
aggattggaccaaccggagagatgggagtggcttctagattatatggacagaaagcatac

SEQ ID NO: 22007 - DNA, 60 bp, Artificial Sequence
  Description of Artificial Sequence: Synthetic probe
cagctgcttgaagattaccgcaaaagtggaatgatggatgaggcggtgaagcagtccgca

SEQ ID NO: 22008 - DNA, 59 bp, Artificial Sequence
  Description of Artificial Sequence: Synthetic probe
ttgaggagtcaaaagatggtgaggggacgcaatcggagagcggccagaagaaagagagc

SEQ ID NO: 22009 - DNA, 60 bp, Artificial Sequence
  Description of Artificial Sequence: Synthetic probe
gctactggatcgcgtgtgatggatgctgctgattgtttccgtaactctgctgaccgtgat

SEQ ID NO: 22010 - DNA, 60 bp, Artificial Sequence
  Description of Artificial Sequence: Synthetic probe
attcgcatcgtacgcggaagcgtttcgtgatgatgtaagattgagacagatcaaacgcca

SEQ ID NO: 22011 - DNA, 60 bp, Artificial Sequence
  Description of Artificial Sequence: Synthetic probe
cgagtaaccatttaaaagggattgtacaagtttcagttcgacctgatcgtacgtttagtg

SEQ ID NO: 22012 - DNA, 60 bp, Artificial Sequence
  Description of Artificial Sequence: Synthetic probe
ctccatatgtggtggcttttcagaagcgatcctatggtatttaccagtcactcatccttc

SEQ ID NO: 22013 - DNA, 60 bp, Artificial Sequence
  Description of Artificial Sequence: Synthetic probe
cggttccagttattttctatgcagataaaatcaggattgtcccggcggaggtaggcgcat

SEQ ID NO: 22014 - DNA, 60 bp, Artificial Sequence
  Description of Artificial Sequence: Synthetic probe
ttttttcctgcgtttagtgacggattacgcattcgtgaatttaagaaagtaagggacata

SEQ ID NO: 22015 - DNA, 60 bp, Artificial Sequence
  Description of Artificial Sequence: Synthetic probe
tcgcaggtcatggttcatctactcgataggttctttgagaagaggcgtttcctgaggacg

SEQ ID NO: 22016 - DNA, 60 bp, Artificial Sequence
  Description of Artificial Sequence: Synthetic probe
gccgacgtagagaaaacttagactataaatcccaatgcccgatcgtaactaaccttttct

SEQ ID NO: 22017 - DNA, 60 bp, Artificial Sequence
  Description of Artificial Sequence: Synthetic probe
tttgagagtatcgttgcaagggacgagtttgagcattaagcaagtcccctcgagcataca

SEQ ID NO: 22018 - DNA, 60 bp, Artificial Sequence
  Description of Artificial Sequence: Synthetic probe
taacgccaggataaagccgtgtgaggtggagctggctgaacgtaagaacaccgatcccta

SEQ ID NO: 22019 - DNA, 60 bp, Artificial Sequence
  Description of Artificial Sequence: Synthetic probe
ccagtgcgatttgtacccagatgagggtgaaatcgtggccaagttcgacgatgcacggta

SEQ ID NO: 22020 - DNA, 60 bp, Artificial Sequence
  Description of Artificial Sequence: Synthetic probe
gcaaaagagtcagcgtaatgatcaggatcggttctacgtgctgatggtgatagctgcttc

SEQ ID NO: 22021 - DNA, 60 bp, Artificial Sequence
  Description of Artificial Sequence: Synthetic probe
gcgtataagaaaactgcgagaggattggttcaggtcttagtcaatggtgtcgtgccggac

SEQ ID NO: 22022 - DNA, 60 bp, Artificial Sequence
  Description of Artificial Sequence: Synthetic probe
gatatgaaagaagaccatagtacggtacaatacgacatgttttcagcaaaactgcatgtc

SEQ ID NO: 22023 - DNA, 60 bp, Artificial Sequence
  Description of Artificial Sequence: Synthetic probe
gttaaaaacgctagcccgaggatggaagagctcgtgatacctgtgataaccgaacgattc

SEQ ID NO: 22024 - DNA, 60 bp, Artificial Sequence
  Description of Artificial Sequence: Synthetic probe
tactacgtgggccgctccattttcagaggcgagcgatattgggtgcgttgaaattcggat

SEQ ID NO: 22025 - DNA, 60 bp, Artificial Sequence
  Description of Artificial Sequence: Synthetic probe
catatactacgtgggccgctccattttcagaggcgagcaatattaggtgcgttgaaattc

SEQ ID NO: 22026 - DNA, 60 bp, Artificial Sequence
  Description of Artificial Sequence: Synthetic probe
gtacatccaatctacctaggatcgcttcactatgatatttcgttcgcggatctgcgaggg

SEQ ID NO: 22027 - DNA, 60 bp, Artificial Sequence
  Description of Artificial Sequence: Synthetic probe
ccgtacacccaatttacctgggatcgcttcactatgatatttcgttcgcggatttgcgag

SEQ ID NO: 22028 - DNA, 60 bp, Artificial Sequence
  Description of Artificial Sequence: Synthetic probe
tatgtggaatagaggataaggttatacatccgaaggttatgatgaaatttaagattccga

SEQ ID NO: 22029 - DNA, 60 bp, Artificial Sequence
  Description of Artificial Sequence: Synthetic probe
ttagctgaagaagatttgcagatgcggcgacttgcgacggctttacagaaggaagtaggc

SEQ ID NO: 22030 - DNA, 60 bp, Artificial Sequence
  Description of Artificial Sequence: Synthetic probe
cagtaggtagagtggcgccccaaggtttgcaccgcatggagtggttgatccagcgatgca

SEQ ID NO: 22031 - DNA, 60 bp, Artificial Sequence
  Description of Artificial Sequence: Synthetic probe
gcatttgcgcaccccgaaaatcgaacctagtgttgtttcaactattcttgagtaccgcac

SEQ ID NO: 22032 - DNA, 60 bp, Artificial Sequence
  Description of Artificial Sequence: Synthetic probe
taacgcatttacgcactccgaaaatcgaacctagtgttgtttcaactattcttgagtacc

SEQ ID NO: 22033 - DNA, 60 bp, Artificial Sequence
  Description of Artificial Sequence: Synthetic probe
ggatcgatctaacgcatttgcgcaccccgaaaatcgaacctagtgttgtttcaactattc

SEQ ID NO: 22034 - DNA, 60 bp, Artificial Sequence
  Description of Artificial Sequence: Synthetic probe
atcggaaaagcggcggaacgattcgctgagagtgagataggttcagcggcgatcgatgga

SEQ ID NO: 22035 - DNA, 60 bp, Artificial Sequence
  Description of Artificial Sequence: Synthetic probe
attggaaaagcggcggagcgattcgctgagagtgagataggttcagcggcgatcgatgga

SEQ ID NO: 22036 - DNA, 60 bp, Artificial Sequence
  Description of Artificial Sequence: Synthetic probe
actgcagtgggatctggatcaagcgcaaaaggacctggagaacgcgcgaacgagaatgtt

SEQ ID NO: 22037 - DNA, 60 bp, Artificial Sequence
  Description of Artificial Sequence: Synthetic probe
aattgtgcgttctaatcctaaccatcatggagaaacagtattgggagctcgaggatagtg

SEQ ID NO: 22038 - DNA, 60 bp, Artificial Sequence
  Description of Artificial Sequence: Synthetic probe
cgagagttaaaccttgtgacgtagaaatagcggaaggtaggagcgatgatccattcgtta

SEQ ID NO: 22039 - DNA, 60 bp, Artificial Sequence
  Description of Artificial Sequence: Synthetic probe
cgactaagtttgatgaagttagatatagcgaaatgatacaagcgattattgatggtggat

SEQ ID NO: 22040 - DNA, 60 bp, Artificial Sequence
  Description of Artificial Sequence: Synthetic probe
cgggagggaaggtgatacattgggaatatgagttaatctcggaagtatacgaggtcagcg

SEQ ID NO: 22041 - DNA, 55 bp, Artificial Sequence
  Description of Artificial Sequence: Synthetic probe
gggcaccaagctggctgcgccaactgtgtagatgtgcgaccaatctatgcacttg

SEQ ID NO: 22042 - DNA, 51 bp, Artificial Sequence
  Description of Artificial Sequence: Synthetic probe
tgggcaccaagctggctgcgccaactgtgtagatgtgcgaccaatctatgc

SEQ ID NO: 22043 - DNA, 56 bp, Artificial Sequence
  Description of Artificial Sequence: Synthetic probe
tgggcaccaagctggctgcgccaactgtgtagatgtgcgaccaatctatgcacttg

SEQ ID NO: 22044 - DNA, 57 bp, Artificial Sequence
  Description of Artificial Sequence: Synthetic probe
agaaaaaacgtctgaggagccagcatgcattggaattactatagagggggttatgag

SEQ ID NO: 22045 - DNA, 60 bp, Artificial Sequence
  Description of Artificial Sequence: Synthetic probe
gaaaagagaagaatgggacgcatgctaaagtcgttgagagagggggacgcaagcagagga

SEQ ID NO: 22046 - DNA, 60 bp, Artificial Sequence
  Description of Artificial Sequence: Synthetic probe
tacggtacgaagattgatgtttacagggacgaggttccagctcagatcatcgaagtggaa

SEQ ID NO: 22047 - DNA, 53 bp, Artificial Sequence
  Description of Artificial Sequence: Synthetic probe
ctgatgcgggagttggagctattggagcgaatggaagaagatgggtagttcta

SEQ ID NO: 22048 - DNA, 60 bp, Artificial Sequence
  Description of Artificial Sequence: Synthetic probe
tggcacgtgaggaatgatctaattgcagcgctgagggaatataaacggaaaatggggatg

SEQ ID NO: 22049 - DNA, 60 bp, Artificial Sequence
  Description of Artificial Sequence: Synthetic probe
ctggcgcttatgtcacagatttgttctggtggtttaagatgattctcgactggtctgcgc

SEQ ID NO: 22050 - DNA, 60 bp, Artificial Sequence
  Description of Artificial Sequence: Synthetic probe
taaaacggatggggttggatttgtctggtcatctatacgtcacattgatgtctggcgctt

SEQ ID NO: 22051 - DNA, 60 bp, Artificial Sequence
  Description of Artificial Sequence: Synthetic probe
cccgatccccctgtgcccgatatttccctatgtagattcatcggactgcgcgttgagtca

SEQ ID NO: 22052 - DNA, 60 bp, Artificial Sequence
  Description of Artificial Sequence: Synthetic probe
atgatccagcgtgggcgatgaattttgctgtctcgttgaaggagccgatacccgatcccc

SEQ ID NO: 22053 - DNA, 60 bp, Artificial Sequence
  Description of Artificial Sequence: Synthetic probe
tacgcgttaccccgatcaactgttatgctcaatggatcttaccgtgatatcagaattcta

SEQ ID NO: 22054 - DNA, 60 bp, Artificial Sequence
  Description of Artificial Sequence: Synthetic probe
cgcagaggataggttgggtgaagagatagcgtatgagatgggcggcgcgttttccagtgc

SEQ ID NO: 22055 - DNA, 60 bp, Artificial Sequence
  Description of Artificial Sequence: Synthetic probe
cggaggaagtgcactatgttggatgcggtgacttacgtaccttgatgcagtttaaaaaac

SEQ ID NO: 22056 - DNA, 60 bp, Artificial Sequence
  Description of Artificial Sequence: Synthetic probe
gcgttgaggaattatgcctttaagatggctattgaatttcacgggtcggaagcggagacg

SEQ ID NO: 22057 - DNA, 60 bp, Artificial Sequence
  Description of Artificial Sequence: Synthetic probe
gcgacagatgtatatgcatacggagatgtatcaaaatggacgatacgacagctacgaggt

SEQ ID NO: 22058 - DNA, 60 bp, Artificial Sequence
  Description of Artificial Sequence: Synthetic probe
gtgtagctttcaagataaatgggaccaaaacggaagtgccttcgtggtttaaaagcctaa

SEQ ID NO: 22059 - DNA, 60 bp, Artificial Sequence
  Description of Artificial Sequence: Synthetic probe
ccattatattgttttgatgagtcatcgaaaaggtatgagttgcagtgtgtaggtgcgtgt

SEQ ID NO: 22060 - DNA, 60 bp, Artificial Sequence
  Description of Artificial Sequence: Synthetic probe
ggtcgcgaagcaaattaaattgaaggatgagcggttcatgagtctatcgagcgctatgcc

SEQ ID NO: 22061 - DNA, 60 bp, Artificial Sequence
  Description of Artificial Sequence: Synthetic probe
cgagaaggtcgcgaagcaaattaaattgaaggatgagcggttcatgagtctatcgagcgc

SEQ ID NO: 22062 - DNA, 60 bp, Artificial Sequence
  Description of Artificial Sequence: Synthetic probe
gcgagtgacgacgaacacccaagaactcatataactaaggaatacatcgagaaggtcgcg

SEQ ID NO: 22063 - DNA, 60 bp, Artificial Sequence
  Description of Artificial Sequence: Synthetic probe
gacgcgagtgacgacgaacacccaagaactcatataactaaggaatacatcgagaaggtc

SEQ ID NO: 22064 - DNA, 60 bp, Artificial Sequence
  Description of Artificial Sequence: Synthetic probe
gccgaaattaagtattgcaaaggaatgggaatcgtgcaaccgtatatgcggaatgatttt

SEQ ID NO: 22065 - DNA, 60 bp, Artificial Sequence
  Description of Artificial Sequence: Synthetic probe
cttttctgcttcgtatgttacggatatgcgccacgtgcagatggaacaatgccggactgg

SEQ ID NO: 22066 - DNA, 60 bp, Artificial Sequence
  Description of Artificial Sequence: Synthetic probe
atcgagagacggtttggctccaatgtttcaaaagtttttcccaaccgtatgaagaggaca

SEQ ID NO: 22067 - DNA, 60 bp, Artificial Sequence
  Description of Artificial Sequence: Synthetic probe
agaggcgatgtatgatcgagagacggtttggctccaatgtttcaaaagtttttctcaacc

SEQ ID NO: 22068 - DNA, 60 bp, Artificial Sequence
  Description of Artificial Sequence: Synthetic probe
taaccaaggagtacattgaaaaagttgcaaagcagattaaattgaaggatgaacggttta

SEQ ID NO: 22069 - DNA, 60 bp, Artificial Sequence
  Description of Artificial Sequence: Synthetic probe
attcgcatcgtacgcggaagcgtttcgtgatgatgtaagattgagacagattaaacgcca

SEQ ID NO: 22070 - DNA, 60 bp, Artificial Sequence
  Description of Artificial Sequence: Synthetic probe
atgaccatgcgtgggcaatgaatttcgctgtctcgttaaaggagccgatacccgatcccc

SEQ ID NO: 22071 - DNA, 60 bp, Artificial Sequence
  Description of Artificial Sequence: Synthetic probe
ggtcgcgatcgtggcagatttgtgaagaacaggctatttgaacaccttcatatcgtacgt

SEQ ID NO: 22072 - DNA, 60 bp, Artificial Sequence
  Description of Artificial Sequence: Synthetic probe
tatcatggtcgcgatcgtggcagatttgtgaagaacaggctatttgaacaccttcatatc

SEQ ID NO: 22073 - DNA, 60 bp, Artificial Sequence
  Description of Artificial Sequence: Synthetic probe
tctcacatcgttaagagtggatttttgccaatatggagattaactggagtagagagtcta

SEQ ID NO: 22074 - DNA, 60 bp, Artificial Sequence
  Description of Artificial Sequence: Synthetic probe
cgacccgtggaataaacgtgtagcgaacggcacgatgaagacttcagctgaatcattggg

SEQ ID NO: 22075 - DNA, 60 bp, Artificial Sequence
  Description of Artificial Sequence: Synthetic probe
cggcggagagaggagacgtacgacagagatatgacgcagcaggggtaagatggtccagac

SEQ ID NO: 22076 - DNA, 60 bp, Artificial Sequence
  Description of Artificial Sequence: Synthetic probe
cgactgtgtagagatgcgacctatctatgcactcggtagcggcagcgggaatacacttac

SEQ ID NO: 22077 - DNA, 60 bp, Artificial Sequence
  Description of Artificial Sequence: Synthetic probe
cgactgtgtagagatgcgacctatctatgcactcggtagcggcagcgggaacacacttac

SEQ ID NO: 22078 - DNA, 60 bp, Artificial Sequence
  Description of Artificial Sequence: Synthetic probe
cgactgtgtagagatgcgacctatctatgcactcggtagcggcagcggaaacacacttac

SEQ ID NO: 22079 - DNA, 60 bp, Artificial Sequence
  Description of Artificial Sequence: Synthetic probe
gcgtgtcgcatttccacgccaacgagtcattctttctagggttcgatttgggtattgatg

SEQ ID NO: 22080 - DNA, 60 bp, Artificial Sequence
  Description of Artificial Sequence: Synthetic probe
ctgcaatgccttacatctatgtgccaattaaagagggtcaaatcgtgaatccaacattta

SEQ ID NO: 22081 - DNA, 60 bp, Artificial Sequence
  Description of Artificial Sequence: Synthetic probe
gggagacagtctggctccaatgcttcaaaagcttttcccaaccatacgaagaggatgtcg

SEQ ID NO: 22082 - DNA, 60 bp, Artificial Sequence
  Description of Artificial Sequence: Synthetic probe
ggcaatgtatgatcgggagacagtctggctccaatgcttcaaaagcttttcccaaccata

SEQ ID NO: 22083 - DNA, 60 bp, Artificial Sequence
  Description of Artificial Sequence: Synthetic probe
gccgcagagcgggtgtataaaattgtcaaggttcccagtatttcgttcagacatatcgta

SEQ ID NO: 22084 - DNA, 60 bp, Artificial Sequence
  Description of Artificial Sequence: Synthetic probe
gcattagccgcagagcgggtgtataaaattgtcaaggttcccagtatttcgttcagacat

SEQ ID NO: 22085 - DNA, 60 bp, Artificial Sequence
  Description of Artificial Sequence: Synthetic probe
gagatgaagatggagatcatgctaatcatcaatccgatgaggatgaacagggtgaagacg

SEQ ID NO: 22086 - DNA, 60 bp, Artificial Sequence
  Description of Artificial Sequence: Synthetic probe
aggaggaggcggatggagatgaagatggagatcatgctaatcatcaagctgatgaggatg

SEQ ID NO: 22087 - DNA, 60 bp, Artificial Sequence
  Description of Artificial Sequence: Synthetic probe
ggctggtgttagctggaatttggatcatcaaagtgaggaggaggcggatggagatgaaga

SEQ ID NO: 22088 - DNA, 60 bp, Artificial Sequence
  Description of Artificial Sequence: Synthetic probe
ttgagacctgagtttgcaatccacggcgtaaatccaatgcctggcccgcttacacgtgcg

SEQ ID NO: 22089 - DNA, 60 bp, Artificial Sequence
  Description of Artificial Sequence: Synthetic probe
gcgggatagatctaacacatcttcgtacgccgaaaattgagcccagcgtagtctctacaa

SEQ ID NO: 22090 - DNA, 60 bp, Artificial Sequence
  Description of Artificial Sequence: Synthetic probe
ggtatgccccgagtgcgccgatgccatcatccatgcctacggttgcccttgaaatactgg

SEQ ID NO: 22091 - DNA, 56 bp, Artificial Sequence
  Description of Artificial Sequence: Synthetic probe
gagcttaatcatattgccggtcggcgtttaggcgcttgtgaccgcgtggttagggg

SEQ ID NO: 22092 - DNA, 60 bp, Artificial Sequence
  Description of Artificial Sequence: Synthetic probe
gacatgagcttgatcatattgccggtcggcgtttaggcgcttgtgaccgcgtggttgggg

SEQ ID NO: 22093 - DNA, 60 bp, Artificial Sequence
  Description of Artificial Sequence: Synthetic probe
gctcgcgttggaagaggaggcatgggctgccgcaaacgacttcgaagatctgatgcttac

SEQ ID NO: 22094 - DNA, 60 bp, Artificial Sequence
  Description of Artificial Sequence: Synthetic probe
aaagctcgcgttggaagaggaggcatgggctgccgcaaacgacttcgaagatctgatgct

SEQ ID NO: 22095 - DNA, 60 bp, Artificial Sequence
  Description of Artificial Sequence: Synthetic probe
tgagcttatcgagcgccatgccgcaagcaagtgggggctttgatcgtatgatagttacta

SEQ ID NO: 22096 - DNA, 60 bp, Artificial Sequence
  Description of Artificial Sequence: Synthetic probe
cggtaaggatgacctttacagagttctcgtcagtcccgctagacggtttcgaactaccat

SEQ ID NO: 22097 - DNA, 60 bp, Artificial Sequence
  Description of Artificial Sequence: Synthetic probe
tgatgatgtgagactaagacagatcaaacgttatgttaatgaacagatcctcccaaagtt

SEQ ID NO: 22098 - DNA, 60 bp, Artificial Sequence
  Description of Artificial Sequence: Synthetic probe
cacaaccgccgagatatgttccgagtgctccaatgccatcatcaatgccaaccgttgccc

SEQ ID NO: 22099 - DNA, 60 bp, Artificial Sequence
  Description of Artificial Sequence: Synthetic probe
tttcacaaccgccgagatatgttccgagtgctccaatgccatcatcaatgccaaccgttg

SEQ ID NO: 22100 - DNA, 56 bp, Artificial Sequence
  Description of Artificial Sequence: Synthetic probe
aaaatctatagagatggacactatcgcagcaagagcgctcactgtgatgcgggcat

SEQ ID NO: 22101 - DNA, 60 bp, Artificial Sequence
  Description of Artificial Sequence: Synthetic probe
gttaaaaatctatagagatggacactatcgcagcaagagcgctcactgtgatgcgggcat

SEQ ID NO: 22102 - DNA, 60 bp, Artificial Sequence
  Description of Artificial Sequence: Synthetic probe
gttaaaaatctatagagatggacactatcgcagcaagagcgctcactgtaatgcgggcat

SEQ ID NO: 22103 - DNA, 60 bp, Artificial Sequence
  Description of Artificial Sequence: Synthetic probe
gttaaaaatctatagagatggacactatcgcagcaagagcgctcaccgtgatgcgggcat

SEQ ID NO: 22104 - DNA, 60 bp, Artificial Sequence
  Description of Artificial Sequence: Synthetic probe
gttaaaaatctatagagatggacactatcgcagcaagggcgctcaccgtaatgcgggcat

SEQ ID NO: 22105 - DNA, 60 bp, Artificial Sequence
  Description of Artificial Sequence: Synthetic probe
gttaaaaatctatagagatggacactatcgcagcaagagcgctcaccgtgatgcgagcat

SEQ ID NO: 22106 - DNA, 60 bp, Artificial Sequence
  Description of Artificial Sequence: Synthetic probe
gcgggatggaagttgcggagccagaagtattaggcgtggaattcaagaacgtgctgcctg

SEQ ID NO: 22107 - DNA, 60 bp, Artificial Sequence
  Description of Artificial Sequence: Synthetic probe
acccaaactgaaaagtgatctaagtggattgaaaaagaagcgagcaatcatacataccac

SEQ ID NO: 22108 - DNA, 60 bp, Artificial Sequence
  Description of Artificial Sequence: Synthetic probe
aacgccatgtaaatgagcagattctacccaaactgaaaagtgatctaagtggattgaaaa

SEQ ID NO: 22109 - DNA, 60 bp, Artificial Sequence
  Description of Artificial Sequence: Synthetic probe
ttaaacgccatgtaaatgagcagattctacccaaactgaaaagtgatctaagtggattga

SEQ ID NO: 22110 - DNA, 60 bp, Artificial Sequence
  Description of Artificial Sequence: Synthetic probe
tcttaagtaaggcggtgaattcgtacaataagatattaactgaagaggacctacaaatgc

SEQ ID NO: 22111 - DNA, 60 bp, Artificial Sequence
  Description of Artificial Sequence: Synthetic probe
catacgatctctgagcagatttggaaagaaagtaggtagcgcgctcacgtctaacacggc

SEQ ID NO: 22112 - DNA, 60 bp, Artificial Sequence
  Description of Artificial Sequence: Synthetic probe
atgggtaaagtcatacgatctctgagcagatttggaaagaaagtaggtagcgcgctcacg

SEQ ID NO: 22113 - DNA, 60 bp, Artificial Sequence
  Description of Artificial Sequence: Synthetic probe
ggacgatttactaacctaactcaaaatatggctcgtcagttggatatcgcgctgaatgac

SEQ ID NO: 22114 - DNA, 60 bp, Artificial Sequence
  Description of Artificial Sequence: Synthetic probe
gttgagttctcaaacacacccgactccttggtattgataaacccaacatatacgatgact

SEQ ID NO: 22115 - DNA, 60 bp, Artificial Sequence
  Description of Artificial Sequence: Synthetic probe
cgaatgttagttgctgcagggaaagattcagaagcggcgtattttcgcagcatgctaccc

SEQ ID NO: 22116 - DNA, 60 bp, Artificial Sequence
  Description of Artificial Sequence: Synthetic probe
cactagagtccaagtcaattatggtccaacaggtgaaccgttagattttcagatcggaag

SEQ ID NO: 22117 - DNA, 60 bp, Artificial Sequence
  Description of Artificial Sequence: Synthetic probe
ccgacccgagatcatcgcggtatggaagttgcggagccagaagtgttgggagtcgaattt

SEQ ID NO: 22118 - DNA, 60 bp, Artificial Sequence
  Description of Artificial Sequence: Synthetic probe
catgatattccgacccgagatcatcgcggtatggaagttgcggagccagaagtgttggga

SEQ ID NO: 22119 - DNA, 60 bp, Artificial Sequence
  Description of Artificial Sequence: Synthetic probe
tgaacgagagtccgcgccacgacttcaggttcagaacgtggcgccaaaggaggagtcgcg

SEQ ID NO: 22120 - DNA, 60 bp, Artificial Sequence
  Description of Artificial Sequence: Synthetic probe
gccccaccagaaatagatcgtgtagttcagtatacttatgagattgcacgtttacaagcg

SEQ ID NO: 22121 - DNA, 60 bp, Artificial Sequence
  Description of Artificial Sequence: Synthetic probe
gatccccatgatcgcgaaagatgggcaaaataatcaaatcgctaagccgttttggcaaaa

SEQ ID NO: 22122 - DNA, 60 bp, Artificial Sequence
  Description of Artificial Sequence: Synthetic probe
gatccccatgatcgcgaaagatgggcaaaataatcaagtcgctaagccgttttggcaaaa

SEQ ID NO: 22123 - DNA, 60 bp, Artificial Sequence
  Description of Artificial Sequence: Synthetic probe
gttccccatgatcgcgaaagatgggcaaaataatcaagtcgctgagccgtttcggcaaaa

SEQ ID NO: 22124 - DNA, 60 bp, Artificial Sequence
  Description of Artificial Sequence: Synthetic probe
gttccccatgatcgcgaaagatgggcaaaataatcaagtcgctgagccgttttggcaaaa

SEQ ID NO: 22125 - DNA, 60 bp, Artificial Sequence
  Description of Artificial Sequence: Synthetic probe
gttaaaaagttccccatgatcgcgaaagatgggcaaaataatcaagtcgctgagccgttt

SEQ ID NO: 22126 - DNA, 60 bp, Artificial Sequence
  Description of Artificial Sequence: Synthetic probe
gttaaaaagatccccatgatcgcgaaagatgggcaaaataatcaagtcgctaagccgttt

SEQ ID NO: 22127 - DNA, 60 bp, Artificial Sequence
  Description of Artificial Sequence: Synthetic probe
gttaaaaagatccccatgatcgcgaaagatgggcaaaataatcaaatcgctaagccgttt

SEQ ID NO: 22128 - DNA, 52 bp, Artificial Sequence
  Description of Artificial Sequence: Synthetic probe
attcgcatcgtacgcagaagcgtttcgtgatgatgtaagattgaggcagatt

SEQ ID NO: 22129 - DNA, 60 bp, Artificial Sequence
  Description of Artificial Sequence: Synthetic probe
ggtacggtttatacgcggaaaaggatcctttatattgcatgatattccgacccgagatca

SEQ ID NO: 22130 - DNA, 60 bp, Artificial Sequence
  Description of Artificial Sequence: Synthetic probe
ccacagtggtttaagagtttaaatccaatgcttggagtggtaaatttaggtgcgactttt

SEQ ID NO: 22131 - DNA, 60 bp, Artificial Sequence
  Description of Artificial Sequence: Synthetic probe
aacggaaataccacagtggtttaagagtttaaatccaatgcttggagtggtaaatttagg

SEQ ID NO: 22132 - DNA, 61 bp, Artificial Sequence
  Description of Artificial Sequence: Synthetic probe
ggtcagaaaagagattatgaagaaacagtcatataatgatgctgtaaggatgagttttgag

SEQ ID NO: 22133 - DNA, 60 bp, Artificial Sequence
  Description of Artificial Sequence: Synthetic probe
cagatcttacctaagttaaagagcgatttaggcggaatgaaaaagaaacggactataata

SEQ ID NO: 22134 - DNA, 60 bp, Artificial Sequence
  Description of Artificial Sequence: Synthetic probe
aacgcaaacacaaaaaacggagaaggctgcatacgcatcgtacgcagaagcgtttcgtga

SEQ ID NO: 22135 - DNA, 60 bp, Artificial Sequence
  Description of Artificial Sequence: Synthetic probe
cgaggacggaagaacagagtttggtacgtgttggagaacggctctcgctcccacccggat

SEQ ID NO: 22136 - DNA, 59 bp, Artificial Sequence
  Description of Artificial Sequence: Synthetic probe
aaaagttgtagcggttgaaatgctgaattactatatgcgtaccgatatattcaaaggag

SEQ ID NO: 22137 - DNA, 60 bp, Artificial Sequence
  Description of Artificial Sequence: Synthetic probe
gaattatatgagatttcatcccgggatcagattgagatctaaagtgctcgatgatgcgga

SEQ ID NO: 22138 - DNA, 60 bp, Artificial Sequence
  Description of Artificial Sequence: Synthetic probe
atatggcctgcgcaggttggagctaactttaatcgatttggcttttttggatttttgaat

SEQ ID NO: 22139 - DNA, 55 bp, Artificial Sequence
  Description of Artificial Sequence: Synthetic probe
tcaagatacatcatacacatcattcgctcgtcaaacgatgcgtatagattgaaga

SEQ ID NO: 22140 - DNA, 60 bp, Artificial Sequence
  Description of Artificial Sequence: Synthetic probe
ttgaacgaaagagcgtgttaagatcggttgaggagtcaagatacatcatacacatcattc

SEQ ID NO: 22141 - DNA, 60 bp, Artificial Sequence
  Description of Artificial Sequence: Synthetic probe
tagttgatttcttctttgaacgaaagagcgtgttaagatcggttgaggagtcaagataca

SEQ ID NO: 22142 - DNA, 51 bp, Artificial Sequence
  Description of Artificial Sequence: Synthetic probe
ccaggattgggagtcacttaaacagtataaacatcatagtattcagtccga

SEQ ID NO: 22143 - DNA, 52 bp, Artificial Sequence
  Description of Artificial Sequence: Synthetic probe
accaggattgggagtcacttaaacagtataaacatcatagtattcagtccga

SEQ ID NO: 22144 - DNA, 60 bp, Artificial Sequence
  Description of Artificial Sequence: Synthetic probe
ctgaacttgtaatgagcttgatgatctaccatgtggaccaggattgggagtcacttaaac

SEQ ID NO: 22145 - DNA, 60 bp, Artificial Sequence
  Description of Artificial Sequence: Synthetic probe
cgacggaaatttaatcggagtgtacgccatgcggcagacaaagcgctagagactaacgcg

SEQ ID NO: 22146 - DNA, 60 bp, Artificial Sequence
  Description of Artificial Sequence: Synthetic probe
tataaaactttgcgacggaaatttaattggagtgtacgccatgcggcagacaaagcgcta

SEQ ID NO: 22147 - DNA, 60 bp, Artificial Sequence
  Description of Artificial Sequence: Synthetic probe
tataaatccttgcgacggaaatttaatcggagtgtacgccatgcggcagacaaagcgcta

SEQ ID NO: 22148 - DNA, 60 bp, Artificial Sequence
  Description of Artificial Sequence: Synthetic probe
tagattcaatgttcctctccgagaatacagagaaaaccaatatcatgcaaaacacgagtg

SEQ ID NO: 22149 - DNA, 60 bp, Artificial Sequence
  Description of Artificial Sequence: Synthetic probe
tgtggaagaatgcgcaaatagatatgagcgatccggggtattcgctttttagaagtggga

SEQ ID NO: 22150 - DNA, 60 bp, Artificial Sequence
  Description of Artificial Sequence: Synthetic probe
gtggtttaagatgattttagaatggtcatcgcaggggagggaacagaagatacgtgattt

SEQ ID NO: 22151 - DNA, 60 bp, Artificial Sequence
  Description of Artificial Sequence: Synthetic probe
cgatcctgcgtgggcgatgaactttgccgtatcattgaaggaacccataccggacccacc

SEQ ID NO: 22152 - DNA, 60 bp, Artificial Sequence
  Description of Artificial Sequence: Synthetic probe
ctaccgtcatgctaaacgggtcgtatcgtgatataagagtcttggatggcaacggcgcga

SEQ ID NO: 22153 - DNA, 60 bp, Artificial Sequence
  Description of Artificial Sequence: Synthetic probe
catcccgatgcggcggtgatgaaagttgtgtcccgtgatgtgcgtagagtggtcgagatg

SEQ ID NO: 22154 - DNA, 60 bp, Artificial Sequence
  Description of Artificial Sequence: Synthetic probe
cgacgagattcgcagaagataggttgggtgaagaaatcgcgtatgagatgggcggagctt

SEQ ID NO: 22155 - DNA, 60 bp, Artificial Sequence
  Description of Artificial Sequence: Synthetic probe
acactatgttggatgcggtgatttacgcactttgatgcagtttaagaaacgttcgcctgg

SEQ ID NO: 22156 - DNA, 60 bp, Artificial Sequence
  Description of Artificial Sequence: Synthetic probe
gtgacgcgctaaggagctacgcttctaaggtcgcgatcgagtttcatggatcagaggcgg

SEQ ID NO: 22157 - DNA, 60 bp, Artificial Sequence
  Description of Artificial Sequence: Synthetic probe
cagcttgcagacatcatcaagacagtcgacgttcgcatatcgcgtgaagttgtcaaaagc

SEQ ID NO: 22158 - DNA, 60 bp, Artificial Sequence
  Description of Artificial Sequence: Synthetic probe
gttggagaatggaaagtacgcgacggatgtttatgcatatggagacgtatcaaagtggac

SEQ ID NO: 22159 - DNA, 60 bp, Artificial Sequence
  Description of Artificial Sequence: Synthetic probe
gttaaaacatgcctgagccacacgcagtactttatgtcacaaacgagctcattcacctcg

SEQ ID NO: 22160 - DNA, 60 bp, Artificial Sequence
  Description of Artificial Sequence: Synthetic probe
aaatcatagattttggatatggagaggggagggtagcaaatacgttgtggaacggaaagc

SEQ ID NO: 22161 - DNA, 60 bp, Artificial Sequence
  Description of Artificial Sequence: Synthetic probe
aaatcatagattttggatatggagaggggagggtagcgaatacgttgtggaacggaaagc

SEQ ID NO: 22162 - DNA, 60 bp, Artificial Sequence
  Description of Artificial Sequence: Synthetic probe
gttatacgttagaacaaatcatagattttggatatggagaggggagggtagcgaatacgt

SEQ ID NO: 22163 - DNA, 60 bp, Artificial Sequence
  Description of Artificial Sequence: Synthetic probe
tgagggttatacgttggagcaaatcatagattttggatatggagaggggagggtagcgaa

SEQ ID NO: 22164 - DNA, 60 bp, Artificial Sequence
  Description of Artificial Sequence: Synthetic probe
tgaaggttatacgttggagcaaatcatagattttggatatggagaggggagggtagcgaa

SEQ ID NO: 22165 - DNA, 60 bp, Artificial Sequence
  Description of Artificial Sequence: Synthetic probe
cggaggcttatagagagttcctcaatctttcgatttcgagcacgttcagtagcgcaatac

SEQ ID NO: 22166 - DNA, 60 bp, Artificial Sequence
  Description of Artificial Sequence: Synthetic probe
cggaggcctatagagagttcctcaatctttcgatttcgagtacgtttagcagcgcgatac

SEQ ID NO: 22167 - DNA, 60 bp, Artificial Sequence
  Description of Artificial Sequence: Synthetic probe
tggacggactttaacggaggcttatagagagttcctcaatctttcgatttcgagcacgtt

SEQ ID NO: 22168 - DNA, 60 bp, Artificial Sequence
  Description of Artificial Sequence: Synthetic probe
catacacccgagagtaatgatgaggtttaagatcccacgtacgcagcagccccaaattca

SEQ ID NO: 22169 - DNA, 60 bp, Artificial Sequence
  Description of Artificial Sequence: Synthetic probe
ggataaagttatacacccgagagtaatgatgaggtttaagatcccacgtacgcaacagcc

SEQ ID NO: 22170 - DNA, 60 bp, Artificial Sequence
  Description of Artificial Sequence: Synthetic probe
atagaggataaagtcatacacccgagagtaatgatgaggtttaagatcccacgtacgcag

SEQ ID NO: 22171 - DNA, 60 bp, Artificial Sequence
  Description of Artificial Sequence: Synthetic probe
cgacgaattgatgacaaaattactcaacgtttaggtcccttgacacggacctgtggcctc

SEQ ID NO: 22172 - DNA, 60 bp, Artificial Sequence
  Description of Artificial Sequence: Synthetic probe
gcgcatgctggttgctgcgggtaaggactcggaggcagcgtattttcgcagtatgttacc

SEQ ID NO: 22173 - DNA, 60 bp, Artificial Sequence
  Description of Artificial Sequence: Synthetic probe
gcatagagatatgctcccagaacctcggcttgatgacatcgaaagatttagacaggaggg

SEQ ID NO: 22174 - DNA, 60 bp, Artificial Sequence
  Description of Artificial Sequence: Synthetic probe
cagcggaggtgatcgaatggaaggagcagatggccgagcgtccatggcacgtgagaaatg

SEQ ID NO: 22175 - DNA, 60 bp, Artificial Sequence
  Description of Artificial Sequence: Synthetic probe
gtcacttgattatacacttgggaagtactacgatatacggttacagctctttggtgatac

SEQ ID NO: 22176 - DNA, 60 bp, Artificial Sequence
  Description of Artificial Sequence: Synthetic probe
gtcacttgattatacacttgggaagtactacgacatacggttacagctctttggtgatac

SEQ ID NO: 22177 - DNA, 60 bp, Artificial Sequence
  Description of Artificial Sequence: Synthetic probe
aacatctatagagtcacttgattatacacttgggaagtactacgacatacggttacagct

SEQ ID NO: 22178 - DNA, 60 bp, Artificial Sequence
  Description of Artificial Sequence: Synthetic probe
aacatctatagagtcacttgattatacacttgggaagtactacgatatacggttacagct

SEQ ID NO: 22179 - DNA, 60 bp, Artificial Sequence
  Description of Artificial Sequence: Synthetic probe
cacgtatagctcgcaaatgcatgctcggaggatgatgcggtcgaagaccgtacaccccat

SEQ ID NO: 22180 - DNA, 60 bp, Artificial Sequence
  Description of Artificial Sequence: Synthetic probe
ttaataacacgtatagctcgcaaatgcatgctcggaggatgatgcggtcgaagaccgtac

SEQ ID NO: 22181 - DNA, 51 bp, Artificial Sequence
  Description of Artificial Sequence: Synthetic probe
tttattggatttgacttaggcatcgacctggttcactacgaagatttgact

SEQ ID NO: 22182 - DNA, 53 bp, Artificial Sequence
  Description of Artificial Sequence: Synthetic probe
cattatgatgttctcaaaaaagcagtaaactcgtacgataaaatcttaaccga

SEQ ID NO: 22183 - DNA, 60 bp, Artificial Sequence
  Description of Artificial Sequence: Synthetic probe
aaatgccattaacctgaggacagtaggtagagtggcgccccgaggtttgcgtcgtgcagg

SEQ ID NO: 22184 - DNA, 60 bp, Artificial Sequence
  Description of Artificial Sequence: Synthetic probe
tcgaaatgccattaacctgaggacagtaggtagagtggcgccccaaggtttgcgtcgtgc

SEQ ID NO: 22185 - DNA, 60 bp, Artificial Sequence
  Description of Artificial Sequence: Synthetic probe
cccgctggatggcttcgaaatgccattaacctgaggacagtaggtagagtggcgccccga

SEQ ID NO: 22186 - DNA, 60 bp, Artificial Sequence
  Description of Artificial Sequence: Synthetic probe
gtggaaaaacgccgcgtatgacagaactaagatacgtgcattggagctctgcaagatact

SEQ ID NO: 22187 - DNA, 60 bp, Artificial Sequence
  Description of Artificial Sequence: Synthetic probe
ttatgtgtagcccactttgcacgggtgtgggttgcacagacggagtgtcggttgtgggag

SEQ ID NO: 22188 - DNA, 60 bp, Artificial Sequence
  Description of Artificial Sequence: Synthetic probe
ttatgtgtagcccactttgcacgggtgtgggttgcacaaacggtgtgtcggttgtgggag

SEQ ID NO: 22189 - DNA, 60 bp, Artificial Sequence
  Description of Artificial Sequence: Synthetic probe
tgcaccctttcaagcgatatgagtgtagcttttaagataaatggaactaagacagaagtg

SEQ ID NO: 22190 - DNA, 60 bp, Artificial Sequence
  Description of Artificial Sequence: Synthetic probe
cactatattagaacatcgtacaagggatatcccggataatgcgttggcggtaagcgttct

SEQ ID NO: 22191 - DNA, 60 bp, Artificial Sequence
  Description of Artificial Sequence: Synthetic probe
ccactatattagaacatcgtacaagggatatcccggataatacgttggcggtaagcgttc

SEQ ID NO: 22192 - DNA, 60 bp, Artificial Sequence
  Description of Artificial Sequence: Synthetic probe
aactgttgtatccactatattagaacatcgtacaagggatatcccggataatacgttggc

SEQ ID NO: 22193 - DNA, 60 bp, Artificial Sequence
  Description of Artificial Sequence: Synthetic probe
caactgttgtatccactatattagaacatcgtacaagggatatcccggataatacgttgg

SEQ ID NO: 22194 - DNA, 60 bp, Artificial Sequence
  Description of Artificial Sequence: Synthetic probe
aaccaactgttgtatccactatattagaacatcgtacaagggatatcccggataatacgt

SEQ ID NO: 22195 - DNA, 60 bp, Artificial Sequence
  Description of Artificial Sequence: Synthetic probe
ctacggaccccgaagatagaaccaactgttgtatccactatattagaacatcgtacaagg

SEQ ID NO: 22196 - DNA, 60 bp, Artificial Sequence
  Description of Artificial Sequence: Synthetic probe
tgtttatactgttttaagacctgagttcgcaatccacggcgtaaacccaatgcctgggcc

SEQ ID NO: 22197 - DNA, 60 bp, Artificial Sequence
  Description of Artificial Sequence: Synthetic probe
gaccccatgatgatatatctagtatggagaagaattgagaacttcgcaatggcgcagggt

SEQ ID NO: 22198 - DNA, 60 bp, Artificial Sequence
  Description of Artificial Sequence: Synthetic probe
agggtcgtaatgaccccatgatgatatatctagtatggagaagaattgagaacttcgcaa

SEQ ID NO: 22199 - DNA, 60 bp, Artificial Sequence
  Description of Artificial Sequence: Synthetic probe
agatggtttatgcgtgccgcccaagcggtgactgcggtagtgtgcggtccggacatgatt

SEQ ID NO: 22200 - DNA, 60 bp, Artificial Sequence
  Description of Artificial Sequence: Synthetic probe
actttccaacctgggagatggtttatgcgtgccgcccaagcggtgactgcggtagtgtgc

SEQ ID NO: 22201 - DNA, 60 bp, Artificial Sequence
  Description of Artificial Sequence: Synthetic probe
tacaacagaagcagcgaatgagatagctcgtgtgactggggagacttcgacgtggggacc

SEQ ID NO: 22202 - DNA, 60 bp, Artificial Sequence
  Description of Artificial Sequence: Synthetic probe
gctacgattggtgtgctagcgacgccagagataccatttacaacagaagcagcgaatgag

SEQ ID NO: 22203 - DNA, 60 bp, Artificial Sequence
  Description of Artificial Sequence: Synthetic probe
acccaacatatggctacgattggtgtgctagcgacgccagagataccatttacaacagaa

SEQ ID NO: 22204 - DNA, 55 bp, Artificial Sequence
  Description of Artificial Sequence: Synthetic probe
aactttacgaggggtgaccatgcgcccaacttcattggcgcagagaaatgagatg

SEQ ID NO: 22205 - DNA, 60 bp, Artificial Sequence
  Description of Artificial Sequence: Synthetic probe
tggagcaaaagcaacgtaaatttactaaaaacatctttgttttagatgtcaatgctaaaa

SEQ ID NO: 22206 - DNA, 60 bp, Artificial Sequence
  Description of Artificial Sequence: Synthetic probe
cgccgctgttgttgcactgttaacatcggtgtgtacgctgtcaagtgacatgagtgtggc

SEQ ID NO: 22207 - DNA, 59 bp, Artificial Sequence
  Description of Artificial Sequence: Synthetic probe
gcgtgtgcaagttaattatggccctacgggggagccgttggatttccagatcggcagga

SEQ ID NO: 22208 - DNA, 60 bp, Artificial Sequence
  Description of Artificial Sequence: Synthetic probe
atgcgcgccgctcaagcggtagctgcagtggtgtgtggtccggatatgattcaggtgtca

SEQ ID NO: 22209 - DNA, 60 bp, Artificial Sequence
  Description of Artificial Sequence: Synthetic probe
caagatacttggagatcggttggacgtgcccctcttcttacgaaatccttgaacgcagcg

SEQ ID NO: 22210 - DNA, 60 bp, Artificial Sequence
  Description of Artificial Sequence: Synthetic probe
cgcggtccgctacatttccagagacgagctatattaggcgcgttaaagtttgggtgcaag

SEQ ID NO: 22211 - DNA, 60 bp, Artificial Sequence
  Description of Artificial Sequence: Synthetic probe
ggtcgaaaacggtgcatccgatttatttgggatctctccactatgacatctctttcgctg

SEQ ID NO: 22212 - DNA, 60 bp, Artificial Sequence
  Description of Artificial Sequence: Synthetic probe
ctatgaggatttaacggctcattggcatgcattgggagcggctcagatggctgtaggacg

SEQ ID NO: 22213 - DNA, 60 bp, Artificial Sequence
  Description of Artificial Sequence: Synthetic probe
cacagcaaccgcaaattcatatttatacggcgccatgggattctgatgatgtattcttct

SEQ ID NO: 22214 - DNA, 60 bp, Artificial Sequence
  Description of Artificial Sequence: Synthetic probe
gcgggtatggcgacagccgtcgcaacgggaagagcgattgagggggcgtataagttgaag

SEQ ID NO: 22215 - DNA, 60 bp, Artificial Sequence
  Description of Artificial Sequence: Synthetic probe
tagaggcagcatctgaggaggtgcccctaatcggagcgggtatggcgacagccgtcgcaa

SEQ ID NO: 22216 - DNA, 60 bp, Artificial Sequence
  Description of Artificial Sequence: Synthetic probe
tgactgctgatgtgttagaggcagcatctgaggaggtgcccctaatcggagcgggtatgg

SEQ ID NO: 22217 - DNA, 60 bp, Artificial Sequence
  Description of Artificial Sequence: Synthetic probe
gattgaaagagacggcatgcaggaagaggcgatacaagaaatagcggggatgactgctga

SEQ ID NO: 22218 - DNA, 60 bp, Artificial Sequence
  Description of Artificial Sequence: Synthetic probe
cggaataagatcgacgctcttaaaagtgcaatagagattgaaagagacggcatgcaggaa

SEQ ID NO: 22219 - DNA, 60 bp, Artificial Sequence
  Description of Artificial Sequence: Synthetic probe
cgattgctctacagaaagagattggtgagaggacacatgtagaaacagctatggtaaaag

SEQ ID NO: 22220 - DNA, 60 bp, Artificial Sequence
  Description of Artificial Sequence: Synthetic probe
attaaccgaagaagaccaacaaatgcgtcgacttgcgattgctctacagaaagagattgg

SEQ ID NO: 22221 - DNA, 60 bp, Artificial Sequence
  Description of Artificial Sequence: Synthetic probe
ggtagtggtgaggagattccggacccgttgagcccgggtgagcaaggtatgcaaactaag

SEQ ID NO: 22222 - DNA, 60 bp, Artificial Sequence
  Description of Artificial Sequence: Synthetic probe
gacaggcgagtcttacggcgaatcggttaaacaggcagtcctactgaatgttctaggtag

SEQ ID NO: 22223 - DNA, 60 bp, Artificial Sequence
  Description of Artificial Sequence: Synthetic probe
ggttcagcggcgactgatggcttagtgcagggtagcgtacattcaatattgacaggcgag

SEQ ID NO: 22224 - DNA, 60 bp, Artificial Sequence
  Description of Artificial Sequence: Synthetic probe
gcaaagcagctgaaagattcgcggaaagtgaaattggttcagcggcgactgatggcttag

SEQ ID NO: 22225 - DNA, 60 bp, Artificial Sequence
  Description of Artificial Sequence: Synthetic probe
tgtgacatccaagttggacacgttgaagatacatctagcttctctatgcttagggctcgc

SEQ ID NO: 22226 - DNA, 57 bp, Artificial Sequence
  Description of Artificial Sequence: Synthetic probe
atcgtaagcgcgcttaactataaaccaactagtaatgatggtatagtggtaccaagg

SEQ ID NO: 22227 - DNA, 60 bp, Artificial Sequence
  Description of Artificial Sequence: Synthetic probe
gtagaggttggtgcatatgcgaatagatttgggttcaaaagttttatgaactttacacgg

SEQ ID NO: 22228 - DNA, 60 bp, Artificial Sequence
  Description of Artificial Sequence: Synthetic probe
gagctatgcaatatcctttccacgattgggcgtaagatgctaaatacgcatgaggagccg

SEQ ID NO: 22229 - DNA, 60 bp, Artificial Sequence
  Description of Artificial Sequence: Synthetic probe
cgcgaataggcaatagtggattaacctatgaacggttcatttcgagcatggtccaggtga

SEQ ID NO: 22230 - DNA, 60 bp, Artificial Sequence
  Description of Artificial Sequence: Synthetic probe
cgcgctagccatgcctgagtgtcagtcgtggggagtgtgacccatttgtacgtcttgcga

SEQ ID NO: 22231 - DNA, 60 bp, Artificial Sequence
  Description of Artificial Sequence: Synthetic probe
tttgcacgggacgcgctagccatgcctgagtgtcagtcgtggggagtgtgacccatttgt

SEQ ID NO: 22232 - DNA, 60 bp, Artificial Sequence
  Description of Artificial Sequence: Synthetic probe
gtgttattgtcttactgcttttgtcaacgctcgctgatgcttatacagtgttgagacccg

SEQ ID NO: 22233 - DNA, 60 bp, Artificial Sequence
  Description of Artificial Sequence: Synthetic probe
gtgtcattgtcttactgcttttgtcaacgctcgctgatgcttacacggtgttgagacccg

SEQ ID NO: 22234 - DNA, 60 bp, Artificial Sequence
  Description of Artificial Sequence: Synthetic probe
agatagagatagtgttattgtcttactgcttttgtcaacgctcgctgatgcttatacagt

SEQ ID NO: 22235 - DNA, 60 bp, Artificial Sequence
  Description of Artificial Sequence: Synthetic probe
agatagagatagtgtcattgtcttactgcttttgtcaacgctcgctgatgcttacacggt

SEQ ID NO: 22236 - DNA, 60 bp, Artificial Sequence
  Description of Artificial Sequence: Synthetic probe
acatggcacgccttgcgtacagcgattttgaatcgaacagcgttgcccggagttatgccg

SEQ ID NO: 22237 - DNA, 60 bp, Artificial Sequence
  Description of Artificial Sequence: Synthetic probe
acatggcatgccttgcgtacggcgattttgaatcgaacagcgttgcccggagttatgccg

SEQ ID NO: 22238 - DNA, 60 bp, Artificial Sequence
  Description of Artificial Sequence: Synthetic probe
cctacatggcacgccttgcgtacagcgattttgaatcgaacagcgttgcccggagttatg

SEQ ID NO: 22239 - DNA, 60 bp, Artificial Sequence
  Description of Artificial Sequence: Synthetic probe
cccacatggcatgccttgcgtacggcgattttgaatcgaacagcgttgcccggagttatg

SEQ ID NO: 22240 - DNA, 60 bp, Artificial Sequence
  Description of Artificial Sequence: Synthetic probe
atgtctcgatggataaaaccttaaatcaataccccgcgttggcagcagaaatttacaacg

SEQ ID NO: 22241 - DNA, 60 bp, Artificial Sequence
  Description of Artificial Sequence: Synthetic probe
ttttctatgtctcgatggataaaaccttaaatcaataccccgcgttggcagcagaaattt

SEQ ID NO: 22242 - DNA, 60 bp, Artificial Sequence
  Description of Artificial Sequence: Synthetic probe
caattcttccaaggacggaatgacccaatgatgatttatatagtttggcgtcggattgag

SEQ ID NO: 22243 - DNA, 60 bp, Artificial Sequence
  Description of Artificial Sequence: Synthetic probe
tgcggatatacagcaattcttccaaggacggaatgacccaatgatgatttatatagtttg

SEQ ID NO: 22244 - DNA, 60 bp, Artificial Sequence
  Description of Artificial Sequence: Synthetic probe
ggggcgcgcgcggatatacagcaattcttccaaggacggaatgacccaatgatgatttat

SEQ ID NO: 22245 - DNA, 60 bp, Artificial Sequence
  Description of Artificial Sequence: Synthetic probe
ctaggaatagcaatcaacagatataatggattgacgttacggggagtaacaatgagacct

SEQ ID NO: 22246 - DNA, 60 bp, Artificial Sequence
  Description of Artificial Sequence: Synthetic probe
atactaggaatagcaatcaacagatataatggattgacattacggggagtaacaatgaga

SEQ ID NO: 22247 - DNA, 60 bp, Artificial Sequence
  Description of Artificial Sequence: Synthetic probe
atgttatggaaatactaggaatagcaatcaacagatataatggattgacgttacggggag

SEQ ID NO: 22248 - DNA, 60 bp, Artificial Sequence
  Description of Artificial Sequence: Synthetic probe
gatgcaaggatagtgttagaagcaaatgttatggaaatactaggaatagcaatcaacaga

SEQ ID NO: 22249 - DNA, 60 bp, Artificial Sequence
  Description of Artificial Sequence: Synthetic probe
aacatcagtggggattatgctaatgccacgagaacttttttggctatatcacctcaatgg

SEQ ID NO: 22250 - DNA, 60 bp, Artificial Sequence
  Description of Artificial Sequence: Synthetic probe
gaaaatacaacatcagtggagactatgctaatgccacgagaacttttttggctatatcac

SEQ ID NO: 22251 - DNA, 60 bp, Artificial Sequence
  Description of Artificial Sequence: Synthetic probe
gcgatgtcaaatacaacgggtgctacgcaaacacaaaaagcggagaaggctgcattcgca

SEQ ID NO: 22252 - DNA, 60 bp, Artificial Sequence
  Description of Artificial Sequence: Synthetic probe
gcaatgtcaaatacaacgggtgctacgcaaacacaaaaagcggagaaggctgcattcgca

SEQ ID NO: 22253 - DNA, 60 bp, Artificial Sequence
  Description of Artificial Sequence: Synthetic probe
tcaggatagagttgaggagctgagtctagtgcgtgtagatgataccatttctcaaccacc

SEQ ID NO: 22254 - DNA, 60 bp, Artificial Sequence
  Description of Artificial Sequence: Synthetic probe
gtctacggcacgcaaatgcatacgagacgtttgatcagatcgaagaccgtacatccaatc

SEQ ID NO: 22255 - DNA, 60 bp, Artificial Sequence
  Description of Artificial Sequence: Synthetic probe
taacgcctacggcacacaaatgcatacgagacgtttgatcagatcgaagaccgtacaccc

SEQ ID NO: 22256 - DNA, 60 bp, Artificial Sequence
  Description of Artificial Sequence: Synthetic probe
ggcgatctctaacgcctacggcacgcaaatgcatacgagacgtttgatcagatcgaagac

SEQ ID NO: 22257 - DNA, 60 bp, Artificial Sequence
  Description of Artificial Sequence: Synthetic probe
tagcgatttctaacgtctacggcacgcaaatgcatacgagacgtttgatcagatcgaaga

SEQ ID NO: 22258 - DNA, 60 bp, Artificial Sequence
  Description of Artificial Sequence: Synthetic probe
actatggtgaaggagtatagggataagatcgatgctttacgaagcgcaattgaggttgaa

SEQ ID NO: 22259 - DNA, 60 bp, Artificial Sequence
  Description of Artificial Sequence: Synthetic probe
aaactactatggtgaaggagtatagggataagatcgatgctctacgaagcgcaattgagg

SEQ ID NO: 22260 - DNA, 60 bp, Artificial Sequence
  Description of Artificial Sequence: Synthetic probe
aataagatattagctgaagaagacttgcagatgcggcgacttgcgacggctttacagaaa

SEQ ID NO: 22261 - DNA, 60 bp, Artificial Sequence
  Description of Artificial Sequence: Synthetic probe
aaagtgtaccctgagcgaagatgggtaaggtcatacgatccctaagccgttttggcaaaa

SEQ ID NO: 22262 - DNA, 60 bp, Artificial Sequence
  Description of Artificial Sequence: Synthetic probe
aaagtgtaccctgagcgaagatgggtaaggtcatacgatccctaagccgatttggcaaaa

SEQ ID NO: 22263 - DNA, 60 bp, Artificial Sequence
  Description of Artificial Sequence: Synthetic probe
aaagtgtaccctgagcgaagatgggtaaggtcatacgatccctaagtcgatttggcaaaa

SEQ ID NO: 22264 - DNA, 60 bp, Artificial Sequence
  Description of Artificial Sequence: Synthetic probe
gttaaaaagtgtaccctgagcgaagatgggtaaggtcatacgatccctaagtcgatttgg

SEQ ID NO: 22265 - DNA, 60 bp, Artificial Sequence
  Description of Artificial Sequence: Synthetic probe
gttaaaaagtgtaccctgagcgaagatgggtaaggtcatacgatccctaagccgttttgg

SEQ ID NO: 22266 - DNA, 60 bp, Artificial Sequence
  Description of Artificial Sequence: Synthetic probe
gttaaaaagtgtaccctgagcgaagatgggtaaggtcatacgatccctaagccgatttgg

SEQ ID NO: 22267 - DNA, 60 bp, Artificial Sequence
  Description of Artificial Sequence: Synthetic probe
cgtcgctgcagccatcgttaaaactcgtgttggaggaggaggcatgggcagctgcaaacg

SEQ ID NO: 22268 - DNA, 60 bp, Artificial Sequence
  Description of Artificial Sequence: Synthetic probe
aaggttgcaaagcagattaaattgaaggatgaacggttcatgagtttatcaagcgctatg

SEQ ID NO: 22269 - DNA, 60 bp, Artificial Sequence
  Description of Artificial Sequence: Synthetic probe
gagaaggttgcaaagcagattaaattgaaggatgaacggtttatgagtctatcaagcgct

SEQ ID NO: 22270 - DNA, 60 bp, Artificial Sequence
  Description of Artificial Sequence: Synthetic probe
aaggaatacattgagaaggttgcaaagcagattaaattgaaggatgaacggtttatgagt

SEQ ID NO: 22271 - DNA, 60 bp, Artificial Sequence
  Description of Artificial Sequence: Synthetic probe
caccgagatatgttgccagagccacggttggacgatattgagaggtttaggcaggagggc

SEQ ID NO: 22272 - DNA, 60 bp, Artificial Sequence
  Description of Artificial Sequence: Synthetic probe
gggctgccgcaaacgacttcgaagatctgatgcttactgatcaggtttatatgcaccgag

SEQ ID NO: 22273 - DNA, 60 bp, Artificial Sequence
  Description of Artificial Sequence: Synthetic probe
ttgggtgttactcccgtcactgcagccatcgttaaagctcgtattggaggaggaagcgtg

SEQ ID NO: 22274 - DNA, 54 bp, Artificial Sequence
  Description of Artificial Sequence: Synthetic probe
ccaagcgaggccatctcacttctggaaggcggttctaaatgacagtccagaggc

SEQ ID NO: 22275 - DNA, 60 bp, Artificial Sequence
  Description of Artificial Sequence: Synthetic probe
acgatatgttcaacgcattattacccgacttaattgctggggcgcatcagaacgccgacc

SEQ ID NO: 22276 - DNA, 60 bp, Artificial Sequence
  Description of Artificial Sequence: Synthetic probe
gattctgaagcggcgtactttcgaagcatgctaccctttcacatggtaaggttcgctaga

SEQ ID NO: 22277 - DNA, 60 bp, Artificial Sequence
  Description of Artificial Sequence: Synthetic probe
gattacgtattcacaagaagttcttactgactttagaagacaggacacgatttgggtttt

SEQ ID NO: 22278 - DNA, 60 bp, Artificial Sequence
  Description of Artificial Sequence: Synthetic probe
tgcatgatattccgaccagagatcatcgtggtatggaagttgcagaaccagaagtgttgg

SEQ ID NO: 22279 - DNA, 52 bp, Artificial Sequence
  Description of Artificial Sequence: Synthetic probe
aagacaggtacaagctgattatatgactgcgacacgagaggttgacttcaca

SEQ ID NO: 22280 - DNA, 60 bp, Artificial Sequence
  Description of Artificial Sequence: Synthetic probe
aggatgaagagggtagagatgagcgggaggatgaggagcaggtgaagaccctgagtgatg

SEQ ID NO: 22281 - DNA, 60 bp, Artificial Sequence
  Description of Artificial Sequence: Synthetic probe
ggcagtactacaaattcacaatccgacccagcaaaatgctatggtgcaaattcaggtggt

SEQ ID NO: 22282 - DNA, 60 bp, Artificial Sequence
  Description of Artificial Sequence: Synthetic probe
tacaagtcgtgttctacatttctatggataagaccttaaatcaataccctgccttgactg

SEQ ID NO: 22283 - DNA, 60 bp, Artificial Sequence
  Description of Artificial Sequence: Synthetic probe
gtccagatacaagttgtgttttacatttctatggataagaccttaaatcaataccctgcc

SEQ ID NO: 22284 - DNA, 60 bp, Artificial Sequence
  Description of Artificial Sequence: Synthetic probe
ggttcagatacaagtcgtgttctacatttctatggataagaccttaaatcaataccctgc

SEQ ID NO: 22285 - DNA, 60 bp, Artificial Sequence
  Description of Artificial Sequence: Synthetic probe
ttccttgaaactgaagagactttccaacccgggagatggttcatgcgtgccgctcaagcg

SEQ ID NO: 22286 - DNA, 60 bp, Artificial Sequence
  Description of Artificial Sequence: Synthetic probe
cagccctatggttttttccttgaaactgaagagactttccaacccgggagatggttcatg

SEQ ID NO: 22287 - DNA, 60 bp, Artificial Sequence
  Description of Artificial Sequence: Synthetic probe
atcagccgccaagatatgctccgagcgcgccaatgccatcatctatgcctactgttgcac

SEQ ID NO: 22288 - DNA, 60 bp, Artificial Sequence
  Description of Artificial Sequence: Synthetic probe
ctcagccgccaagatatgctccgagcgcgccaatgccatcatctatgcctactgtcgcac

SEQ ID NO: 22289 - DNA, 60 bp, Artificial Sequence
  Description of Artificial Sequence: Synthetic probe
tgatacaatttatcagccgccaagatatgctccgagcgcgccaatgccatcatctatgcc

SEQ ID NO: 22290 - DNA, 60 bp, Artificial Sequence
  Description of Artificial Sequence: Synthetic probe
atacaatttatcagccgccaagatatgctccgagcgcgccaatgccatcatctatgccta

SEQ ID NO: 22291 - DNA, 60 bp, Artificial Sequence
  Description of Artificial Sequence: Synthetic probe
gctcgaagattaccgcaaaagtgggatgatggatgaggccgtgaagcaatctgcattggt

SEQ ID NO: 22292 - DNA, 60 bp, Artificial Sequence
  Description of Artificial Sequence: Synthetic probe
ttcaagttcatagcgtggcgccaagggaggagtcgcgctggatggatgatgatgaggcga

SEQ ID NO: 22293 - DNA, 60 bp, Artificial Sequence
  Description of Artificial Sequence: Synthetic probe
acagatgcacatattgaggggaccactacatttccaaaggcgggcgatactaggcgcgat

SEQ ID NO: 22294 - DNA, 60 bp, Artificial Sequence
  Description of Artificial Sequence: Synthetic probe
agcacaattggaaaagcggctgaacgatttgcagatagcgagattggctcagcggctatt

SEQ ID NO: 22295 - DNA, 60 bp, Artificial Sequence
  Description of Artificial Sequence: Synthetic probe
gataaatttcctgagaatggatgatttcgcgaagcactttaatagatatgcttcgatggc

SEQ ID NO: 22296 - DNA, 60 bp, Artificial Sequence
  Description of Artificial Sequence: Synthetic probe
atgataaatttcctgagaatggatgatttcgcgaagcactttaatagatatgcttcgatg

SEQ ID NO: 22297 - DNA, 60 bp, Artificial Sequence
  Description of Artificial Sequence: Synthetic probe
attcaggctacaaaggtagggtttttcaagtgatgtttctaccaatccaaatgataaatt

SEQ ID NO: 22298 - DNA, 60 bp, Artificial Sequence
  Description of Artificial Sequence: Synthetic probe
ggtctaacccttacccgtgtttacgaggcgcgctaattgcggcggagtgcaaattgggcg

SEQ ID NO: 22299 - DNA, 50 bp, Artificial Sequence
  Description of Artificial Sequence: Synthetic probe
ggcgtttaggcgcttgtgaccgcgtggttagggggggattttacacttac

SEQ ID NO: 22300 - DNA, 54 bp, Artificial Sequence
  Description of Artificial Sequence: Synthetic probe
ggtcggtgtttaggcgcttgtgaccgcgtggttagggggggattttacacttac

SEQ ID NO: 22301 - DNA, 60 bp, Artificial Sequence
  Description of Artificial Sequence: Synthetic probe
tccggctagcattagagcggggcgtataaggctaagatttccgctgagcgcgcgacatct

SEQ ID NO: 22302 - DNA, 60 bp, Artificial Sequence
  Description of Artificial Sequence: Synthetic probe
ttccctcaaaggcgattcgatctagcaaactgaatgaagcgcagcccaagattgcacgcg

SEQ ID NO: 22303 - DNA, 60 bp, Artificial Sequence
  Description of Artificial Sequence: Synthetic probe
ggcactttcgcgacaacaggcacagtccacttacgacgaagagatatcgaaaagacagga

SEQ ID NO: 22304 - DNA, 60 bp, Artificial Sequence
  Description of Artificial Sequence: Synthetic probe
acccagaggatgatgatgtaatagtcacaaagttcgacgatgccgcgtatggtcaaatga

SEQ ID NO: 22305 - DNA, 60 bp, Artificial Sequence
  Description of Artificial Sequence: Synthetic probe
cctgagcgcctgaagatatttgagcataggaatcagcgtagagatgaggatcggttctat

SEQ ID NO: 22306 - DNA, 60 bp, Artificial Sequence
  Description of Artificial Sequence: Synthetic probe
gaggacgcgtcaaaggggtgtttgcatacgagaaccatgatgtggaatcacctagtacga

SEQ ID NO: 22307 - DNA, 60 bp, Artificial Sequence
  Description of Artificial Sequence: Synthetic probe
gtaacgaaaataccagaaatgaatgcatatgacatcaagcaggaaagtatccggaccgca

SEQ ID NO: 22308 - DNA, 60 bp, Artificial Sequence
  Description of Artificial Sequence: Synthetic probe
ttaacaggtatgcttcgatggcgatacaacaatatttgagagttggttatgctgaagaga

SEQ ID NO: 22309 - DNA, 56 bp, Artificial Sequence
  Description of Artificial Sequence: Synthetic probe
ttttccttgaaactgaggagactttccaacctggaagatggttcatgcgcgccgct

SEQ ID NO: 22310 - DNA, 60 bp, Artificial Sequence
  Description of Artificial Sequence: Synthetic probe
gggactagcgcaagaggcgagcgggcgtacgttaacggaggcgtatcgtgagtttctcaa

SEQ ID NO: 22311 - DNA, 60 bp, Artificial Sequence
  Description of Artificial Sequence: Synthetic probe
ctcagcagaatgcaatggtgcagatacaagtggttttctatatctcaatggataagactt

SEQ ID NO: 22312 - DNA, 60 bp, Artificial Sequence
  Description of Artificial Sequence: Synthetic probe
ctcagcagaatgcaatggtgcagatacaagtggttttctatatctcgatggataagactt

SEQ ID NO: 22313 - DNA, 60 bp, Artificial Sequence
  Description of Artificial Sequence: Synthetic probe
ctactcagcagaatgcaatggtgcagatacaagtggttttctatatctcaatggataaga

SEQ ID NO: 22314 - DNA, 60 bp, Artificial Sequence
  Description of Artificial Sequence: Synthetic probe
ctactcagcagaatgcaatggtgcagatacaagtggttttctatatctcgatggataaga

SEQ ID NO: 22315 - DNA, 60 bp, Artificial Sequence
  Description of Artificial Sequence: Synthetic probe
gtcgcatataagggtaaaatgagaatcatggatattacgcaatcgctcaaaatgggcact

SEQ ID NO: 22316 - DNA, 60 bp, Artificial Sequence
  Description of Artificial Sequence: Synthetic probe
cgcatcgtaatgagatgctggaagttgccccattgattgaatctgtttacgcgtcggagt

SEQ ID NO: 22317 - DNA, 60 bp, Artificial Sequence
  Description of Artificial Sequence: Synthetic probe
gagatgctacgcatgctagttgccgcaggtaaggattcggaggcggcgtattttcgtagt

SEQ ID NO: 22318 - DNA, 60 bp, Artificial Sequence
  Description of Artificial Sequence: Synthetic probe
cggcgggaggacgatttactaacctaactcagaacatggctcgtcaattggacatcgcgt

SEQ ID NO: 22319 - DNA, 60 bp, Artificial Sequence
  Description of Artificial Sequence: Synthetic probe
cgaatcacaacgaccggacccttcgcaatattgactggatcaacgccaaccgcgcagcag

SEQ ID NO: 22320 - DNA, 60 bp, Artificial Sequence
  Description of Artificial Sequence: Synthetic probe
atgcaatcaagggaccgagtgctgcgggtggatacatattatgaggagatgtcacaggtg

SEQ ID NO: 22321 - DNA, 60 bp, Artificial Sequence
  Description of Artificial Sequence: Synthetic probe
tgcgtgggccgatacattttcagcgcagggcaatcttaggtgcacttaaacatggcatta

SEQ ID NO: 22322 - DNA, 52 bp, Artificial Sequence
  Description of Artificial Sequence: Synthetic probe
ttttaggtcgtgcgatgatggatccctcgagcggagcgatgcataagagaag

SEQ ID NO: 22323 - DNA, 60 bp, Artificial Sequence
  Description of Artificial Sequence: Synthetic probe
ggcatgctttaggcgccgcgcaaatggttgttggacgcacgttccaagaggcgtatcgag

SEQ ID NO: 22324 - DNA, 60 bp, Artificial Sequence
  Description of Artificial Sequence: Synthetic probe
accgcgcattggcatgctttaggcgccgcgcaaatggttgttggacgcacgttccaagag

SEQ ID NO: 22325 - DNA, 60 bp, Artificial Sequence
  Description of Artificial Sequence: Synthetic probe
tagagtatagagataggccaattccagatgattcactagcagtcagcgtacttgagaaga

SEQ ID NO: 22326 - DNA, 60 bp, Artificial Sequence
  Description of Artificial Sequence: Synthetic probe
cgggcgagtcctatggtgaatcggtaaaacaggcagtactgcttaatgtgctaggcagtg

SEQ ID NO: 22327 - DNA, 60 bp, Artificial Sequence
  Description of Artificial Sequence: Synthetic probe
ttcactcgatcatgacgggcgagtcctatggtgaatcggtaaaacaggcagtactgctta

SEQ ID NO: 22328 - DNA, 60 bp, Artificial Sequence
  Description of Artificial Sequence: Synthetic probe
cgagagtgaggtgggtgcagccacgatagatggaattgttcagggaagcgttcactcgat

SEQ ID NO: 22329 - DNA, 60 bp, Artificial Sequence
  Description of Artificial Sequence: Synthetic probe
tttcgcaaccaccgagatatgctccgagtgccccaacgccgtcatcaatgccaaccgttg

SEQ ID NO: 22330 - DNA, 60 bp, Artificial Sequence
  Description of Artificial Sequence: Synthetic probe
caagataatatttcatattggcatagacagtggtcgatcccaatgattctatttgatgaa

SEQ ID NO: 22331 - DNA, 60 bp, Artificial Sequence
  Description of Artificial Sequence: Synthetic probe
tgtttgatcgtatgattcaaggcggatgggatcaggaacggttcaaattacacaacatat

SEQ ID NO: 22332 - DNA, 57 bp, Artificial Sequence
  Description of Artificial Sequence: Synthetic probe
gatcggacgtaaaatgttagatgttcaagaagagccgaaggatgagatggcgttatc

SEQ ID NO: 22333 - DNA, 60 bp, Artificial Sequence
  Description of Artificial Sequence: Synthetic probe
ctttcggcgatcggacgtaaaatgttagatgttcaagaagagccaaaggatgagatggcg

SEQ ID NO: 22334 - DNA, 60 bp, Artificial Sequence
  Description of Artificial Sequence: Synthetic probe
aagcgtttcgtgatgatgtaagattaagacaaattaaacgccatgtaaatgaacagattt

SEQ ID NO: 22335 - DNA, 60 bp, Artificial Sequence
  Description of Artificial Sequence: Synthetic probe
ttggccagatcaccagggcgatcgcgcgcgctgcgtatgtctagctgcgtttgcacggga

SEQ ID NO: 22336 - DNA, 60 bp, Artificial Sequence
  Description of Artificial Sequence: Synthetic probe
gacccgaatttgtcatccacggtgtcgctccaattgttggccagatcaccagggcgatcg

SEQ ID NO: 22337 - DNA, 60 bp, Artificial Sequence
  Description of Artificial Sequence: Synthetic probe
cccgcgttggcagcagaaatttataacgtatatagcttcagagatcctacatggcacgcc

SEQ ID NO: 22338 - DNA, 60 bp, Artificial Sequence
  Description of Artificial Sequence: Synthetic probe
ccaggtcgttttctatgtctcgatggacaaaaccttaaatcaataccccgcgttggcagc

SEQ ID NO: 22339 - DNA, 60 bp, Artificial Sequence
  Description of Artificial Sequence: Synthetic probe
cgcaggctggcgtagtagtgagcattggcggtgtgaatataagagcaggaaggatcacgg

SEQ ID NO: 22340 - DNA, 60 bp, Artificial Sequence
  Description of Artificial Sequence: Synthetic probe
gatgatttatatagtttggcgccggattgagattttttcgaacgcacaagggaactcaat

SEQ ID NO: 22341 - DNA, 60 bp, Artificial Sequence
  Description of Artificial Sequence: Synthetic probe
ttactcctgtaattagtggtcccgacatggttcaagtttctatgaatgcgggggcgcgcg

SEQ ID NO: 22342 - DNA, 60 bp, Artificial Sequence
  Description of Artificial Sequence: Synthetic probe
aacaatgagacctgcctcgcaagcccaaagaaacgacatgttcttcatgtgcttggatat

SEQ ID NO: 22343 - DNA, 51 bp, Artificial Sequence
  Description of Artificial Sequence: Synthetic probe
ttaaacgccatgtaaatgaacagattctacccaaactgaaaagtgatttaa

SEQ ID NO: 22344 - DNA, 60 bp, Artificial Sequence
  Description of Artificial Sequence: Synthetic probe
ccgcaaaagtgggatgatggatgaggccgtgaagcagtctgcattggttaattcggaaag

SEQ ID NO: 22345 - DNA, 60 bp, Artificial Sequence
  Description of Artificial Sequence: Synthetic probe
cacaaccaccaagatatgctccgagtgccccagtgccttcatcgatgccaaccgttgccc

SEQ ID NO: 22346 - DNA, 60 bp, Artificial Sequence
  Description of Artificial Sequence: Synthetic probe
tttcacaaccaccaagatatgctccgagtgccccagtgccttcatcgatgccaaccgttg

SEQ ID NO: 22347 - DNA, 59 bp, Artificial Sequence
  Description of Artificial Sequence: Synthetic probe
aacggatcaattcaccgatgtttaatgcccggctcaaaattgcgcgtggcgagattgca

SEQ ID NO: 22348 - DNA, 60 bp, Artificial Sequence
  Description of Artificial Sequence: Synthetic probe
ggcgcgcgttctgaattagtattcccaccctactatgacaaacggatcaattcaccgatg

SEQ ID NO: 22349 - DNA, 60 bp, Artificial Sequence
  Description of Artificial Sequence: Synthetic probe
tgcttaccttggcgcgcgttctgaattagtattcccaccctactatgacaaacggatcaa

SEQ ID NO: 22350 - DNA, 51 bp, Artificial Sequence
  Description of Artificial Sequence: Synthetic probe
aaattccggatgagattaggaccgaaatcgctgaacttaataggataagag

SEQ ID NO: 22351 - DNA, 60 bp, Artificial Sequence
  Description of Artificial Sequence: Synthetic probe
gtggtcgtgccgagattgttagatataacgctacgcgcttatgataataggaaatccaca

SEQ ID NO: 22352 - DNA, 60 bp, Artificial Sequence
  Description of Artificial Sequence: Synthetic probe
gaggctctaaattatagaccgagaaggaacgatggtgtggtcgtgccgagattgttagat

SEQ ID NO: 22353 - DNA, 60 bp, Artificial Sequence
  Description of Artificial Sequence: Synthetic probe
ggtcaagtatcatagaggctctaaattatagaccgagaaggaacgatggtgtggtcgtgc

SEQ ID NO: 22354 - DNA, 51 bp, Artificial Sequence
  Description of Artificial Sequence: Synthetic probe
tattctaaggggacctttgcactttcaacgccgagccattctgggagcgct

SEQ ID NO: 22355 - DNA, 60 bp, Artificial Sequence
  Description of Artificial Sequence: Synthetic probe
attgcgtttcacaccatcatcggaatgaatccttcttcttgggatttgatttaggaatcg

SEQ ID NO: 22356 - DNA, 59 bp, Artificial Sequence
  Description of Artificial Sequence: Synthetic probe
aacgcagcagccgcaaatccacatttatgcggctccgtgggattctgatgacgtgtttt

SEQ ID NO: 22357 - DNA, 60 bp, Artificial Sequence
  Description of Artificial Sequence: Synthetic probe
aacgcagcaaccgcaaatccacatttatgcggctccgtgggattctgatgacgtgttttt

SEQ ID NO: 22358 - DNA, 59 bp, Artificial Sequence
  Description of Artificial Sequence: Synthetic probe
aacgcagcaaccgcaaatccacatttatgcggctccgtgggattctgatgacgtgtttt

SEQ ID NO: 22359 - DNA, 60 bp, Artificial Sequence
  Description of Artificial Sequence: Synthetic probe
aacgcagcagccgcaaatccacatttatgcggctccgtgggattctgatgacgtgttttt

SEQ ID NO: 22360 - DNA, 60 bp, Artificial Sequence
  Description of Artificial Sequence: Synthetic probe
gcagaggactcgaaaatggcaatgttggcacgcgcactgcagcgggaggcttcagagaga

SEQ ID NO: 22361 - DNA, 60 bp, Artificial Sequence
  Description of Artificial Sequence: Synthetic probe
tgttaggtacaggtgaagagttaccagaccctctgagccccggcgaacgtggtatccaaa

SEQ ID NO: 22362 - DNA, 60 bp, Artificial Sequence
  Description of Artificial Sequence: Synthetic probe
cggagaaggctgcattcgcatcgtacgcagaagcgtttcgtgatgacgtgaggttgagac

SEQ ID NO: 22363 - DNA, 60 bp, Artificial Sequence
  Description of Artificial Sequence: Synthetic probe
ccaacatttatatcaagatatcgccaaattgcatactatttctacaacccggatgcggct

SEQ ID NO: 22364 - DNA, 60 bp, Artificial Sequence
  Description of Artificial Sequence: Synthetic probe
gcctgagccacacgcagtactctatgtcacaaatgagctctctcatatcgttaagaatgg

SEQ ID NO: 22365 - DNA, 60 bp, Artificial Sequence
  Description of Artificial Sequence: Synthetic probe
gcctgagccacacgcagtactctatgtcacaaacgagctctctcacatcgttaagagtgg

SEQ ID NO: 22366 - DNA, 60 bp, Artificial Sequence
  Description of Artificial Sequence: Synthetic probe
ctacgacatccgccctgctataatgggacaggcactctcacggcaacagggacaatccac

SEQ ID NO: 22367 - DNA, 60 bp, Artificial Sequence
  Description of Artificial Sequence: Synthetic probe
ttctacgacatccgccctgctataatgggacaggcactctcacggcaacagggacaatcc

SEQ ID NO: 22368 - DNA, 60 bp, Artificial Sequence
  Description of Artificial Sequence: Synthetic probe
cgcttttgatcctattgtgttgcagaggctaacattagcgcgtttctacgacatccgccc

SEQ ID NO: 22369 - DNA, 60 bp, Artificial Sequence
  Description of Artificial Sequence: Synthetic probe
ctcccatcgcttttgatcctattgtgttgcagaggctaacattagcgcgtttctacgaca

SEQ ID NO: 22370 - DNA, 60 bp, Artificial Sequence
  Description of Artificial Sequence: Synthetic probe
cgcacaacgacggaatgatgatccgatggtgaaacgcacgttatctcccatcgcttttga

SEQ ID NO: 22371 - DNA, 60 bp, Artificial Sequence
  Description of Artificial Sequence: Synthetic probe
tgaaatcgcacaacgacggaatgatgatccgatggtgaaacgcacgttatctcccatcgc

SEQ ID NO: 22372 - DNA, 60 bp, Artificial Sequence
  Description of Artificial Sequence: Synthetic probe
cgccaatgtttaacgctaaattgcgaatcaagcatagtgaaatcgcacaacgacggaatg

SEQ ID NO: 22373 - DNA, 60 bp, Artificial Sequence
  Description of Artificial Sequence: Synthetic probe
aagtggataatagcgccaatgtttaacgctaaattgcgaatcaagcatagtgaaatcgca

SEQ ID NO: 22374 - DNA, 52 bp, Artificial Sequence
  Description of Artificial Sequence: Synthetic probe
ggggtcacgatgcctgaatattttgacaagtggataatagcgccaatgttta

SEQ ID NO: 22375 - DNA, 60 bp, Artificial Sequence
  Description of Artificial Sequence: Synthetic probe
atgctaagttgacatctaatgagggggtcacgatgcctgaatattttgacaagtggataa

SEQ ID NO: 22376 - DNA, 60 bp, Artificial Sequence
  Description of Artificial Sequence: Synthetic probe
gttaaatcaacagactaaggacatcacttatgagcagggcaacccttgcgacttattccc

SEQ ID NO: 22377 - DNA, 60 bp, Artificial Sequence
  Description of Artificial Sequence: Synthetic probe
tgggagtataagttaaatcaacagactaaggacatcacttatgagcagggcaacccttgc

SEQ ID NO: 22378 - DNA, 60 bp, Artificial Sequence
  Description of Artificial Sequence: Synthetic probe
ttcgatgatgcgatcgtggtatgactggagcgttagacccacatatactccctatgaaaa

SEQ ID NO: 22379 - DNA, 60 bp, Artificial Sequence
  Description of Artificial Sequence: Synthetic probe
tattcgatgatgcgatcgtggtatgactggagcgttagacccacatatactccctatgaa

SEQ ID NO: 22380 - DNA, 60 bp, Artificial Sequence
  Description of Artificial Sequence: Synthetic probe
gggacgttgatggcttctgaaacgaagctcggcgatgtttattcgatgatgcgatcgtgg

SEQ ID NO: 22381 - DNA, 60 bp, Artificial Sequence
  Description of Artificial Sequence: Synthetic probe
catgtttacgggggacgttgatggcttctgaaacgaagctcggcgatgtttattcgatga

SEQ ID NO: 22382 - DNA, 60 bp, Artificial Sequence
  Description of Artificial Sequence: Synthetic probe
ggaccgattttatattttactgatgattgccgcttcagatacatttaatacgcgcgtatg

SEQ ID NO: 22383 - DNA, 60 bp, Artificial Sequence
  Description of Artificial Sequence: Synthetic probe
gacccagaacgcttaaaaacatttgagcatagaaatcaacgtagagatgaggaccgattt

SEQ ID NO: 22384 - DNA, 60 bp, Artificial Sequence
  Description of Artificial Sequence: Synthetic probe
ggccggaaaatgttggatcaagagaaagaacctgcggatgaggcaagcttatcaattcgg

SEQ ID NO: 22385 - DNA, 60 bp, Artificial Sequence
  Description of Artificial Sequence: Synthetic probe
ctgttggccggaaaatgttggatcaagagaaagaacctgcggatgaggcaagcttatcaa

SEQ ID NO: 22386 - DNA, 60 bp, Artificial Sequence
  Description of Artificial Sequence: Synthetic probe
ccgccgaatgatcgagacagtgtactcacgatcctactactgtcgacgctcgcagatgtt

SEQ ID NO: 22387 - DNA, 60 bp, Artificial Sequence
  Description of Artificial Sequence: Synthetic probe
atctttccgccgaatgatcgagacagtgtactcacgatcctactactgtcgacgctcgca

SEQ ID NO: 22388 - DNA, 60 bp, Artificial Sequence
  Description of Artificial Sequence: Synthetic probe
ggtacaaattcaggtagtattctacgtttccatggacaagacgcttaaccagtaccctgc

SEQ ID NO: 22389 - DNA, 60 bp, Artificial Sequence
  Description of Artificial Sequence: Synthetic probe
aaaacgctatggtacaaattcaggtagtattctacgtttccatggacaagacgcttaacc

SEQ ID NO: 22390 - DNA, 60 bp, Artificial Sequence
  Description of Artificial Sequence: Synthetic probe
cagcagcgggaatcaatgttggcccaatttcacctgactatacgcaacacatggccacca

SEQ ID NO: 22391 - DNA, 60 bp, Artificial Sequence
  Description of Artificial Sequence: Synthetic probe
ggcatggattgagaactgcgatcttgaagagaaccactttaccaaatatgctaccaccaa

SEQ ID NO: 22392 - DNA, 53 bp, Artificial Sequence
  Description of Artificial Sequence: Synthetic probe
aaaagtgtcgctgccatgctatccgggctgatccaaaggttcgaggaggaaaa

SEQ ID NO: 22393 - DNA, 56 bp, Artificial Sequence
  Description of Artificial Sequence: Synthetic probe
aaaagtgtcgctgccatgctatccgggctgatccaaaggttcgaggaagaaaagat

SEQ ID NO: 22394 - DNA, 56 bp, Artificial Sequence
  Description of Artificial Sequence: Synthetic probe
aaaagtgtcgctgccatgctatccgggctgatccgaaggttcgaagaagaaaagat

SEQ ID NO: 22395 - DNA, 60 bp, Artificial Sequence
  Description of Artificial Sequence: Synthetic probe
gttaaaaagtgtcgctgccatgctatccgggctgatccgaaggttcgaagaagaaaagat

SEQ ID NO: 22396 - DNA, 60 bp, Artificial Sequence
  Description of Artificial Sequence: Synthetic probe
gttaaaaagtgtcgctgccatgctatccgggctgatccaaaggttcgaggaggaaaaaat

SEQ ID NO: 22397 - DNA, 60 bp, Artificial Sequence
  Description of Artificial Sequence: Synthetic probe
gttaaaaagtgtcgctgccatgctatccgggctgatccaaaggttcgaggaagaaaagat

SEQ ID NO: 22398 - DNA, 60 bp, Artificial Sequence
  Description of Artificial Sequence: Synthetic probe
cgttgtgcacgctgacaggagagatcggagtcaacccttccggcctggtgatcaaacatt

SEQ ID NO: 22399 - DNA, 60 bp, Artificial Sequence
  Description of Artificial Sequence: Synthetic probe
gatatcgttgtgcacgctgacaggagagatcggagtcaacccttccggcctggtgatcaa

SEQ ID NO: 22400 - DNA, 60 bp, Artificial Sequence
  Description of Artificial Sequence: Synthetic probe
gcgtcggaggtgttgacatgagggcaggacgcataatcgcgtgggatgggcaggccgctc

SEQ ID NO: 22401 - DNA, 60 bp, Artificial Sequence
  Description of Artificial Sequence: Synthetic probe
ccgagcagacggagagatcgagagatctgcggcgaaaagagaagaatggcacgcatgcta

SEQ ID NO: 22402 - DNA, 60 bp, Artificial Sequence
  Description of Artificial Sequence: Synthetic probe
gttccaagaggcgtaccgagagtttttaggtcgtgcgatgatggatccttcaagcggagc

SEQ ID NO: 22403 - DNA, 60 bp, Artificial Sequence
  Description of Artificial Sequence: Synthetic probe
gatccccagatctcagcagcctcagattcacatttattgttcaccgtgggattcagacac

SEQ ID NO: 22404 - DNA, 60 bp, Artificial Sequence
  Description of Artificial Sequence: Synthetic probe
tggaggatgagcaacgcaatgagctggtccgtttgaaactgaataagaaaatagttgaca

SEQ ID NO: 22405 - DNA, 56 bp, Artificial Sequence
  Description of Artificial Sequence: Synthetic probe
ctaggcagtggtgaagagttacctgatcccctaagtccaggagaacgcgggataca

SEQ ID NO: 22406 - DNA, 60 bp, Artificial Sequence
  Description of Artificial Sequence: Synthetic probe
agaaagtggggaacgttctgacgtcaaatacggcaaagaagatttacagtacgattggga

SEQ ID NO: 22407 - DNA, 60 bp, Artificial Sequence
  Description of Artificial Sequence: Synthetic probe
gcggtgaggatgagtttcacagagttctcatcagtcccgctagacggtttcgaattacca

SEQ ID NO: 22408 - DNA, 60 bp, Artificial Sequence
  Description of Artificial Sequence: Synthetic probe
cgcggtgaggatgagtttcacagagttctcatcagtcccgctagacggtttcgaattacc

SEQ ID NO: 22409 - DNA, 60 bp, Artificial Sequence
  Description of Artificial Sequence: Synthetic probe
gcttatcgccgctgttgttgcactgttaacatcggtgtgtacgctgtcaagtgacatgag

SEQ ID NO: 22410 - DNA, 60 bp, Artificial Sequence
  Description of Artificial Sequence: Synthetic probe
atacacatgacgttgcttatcgccgctgttgttgcactgttaacatcggtgtgtacgctg

SEQ ID NO: 22411 - DNA, 60 bp, Artificial Sequence
  Description of Artificial Sequence: Synthetic probe
tcgatgcattacgatattacttatgaaacgttaaagacgaacgccacagaggctcgatat

SEQ ID NO: 22412 - DNA, 60 bp, Artificial Sequence
  Description of Artificial Sequence: Synthetic probe
tttttaggcttcgatttgggaattgacgttgttcatttcgaggacctcgctgcgcactgg

SEQ ID NO: 22413 - DNA, 60 bp, Artificial Sequence
  Description of Artificial Sequence: Synthetic probe
ccgaaaattgagccaactatggttgcgacaacgttagagcatagattcaaggagataccg

SEQ ID NO: 22414 - DNA, 60 bp, Artificial Sequence
  Description of Artificial Sequence: Synthetic probe
tgaatgtgctcggcgcaggagatgagatcccggacccacttagtcctggagagcgtggca

SEQ ID NO: 22415 - DNA, 60 bp, Artificial Sequence
  Description of Artificial Sequence: Synthetic probe
ggaaggcagcggagcgttttgctgaaagtgagattggttcggccgcgattgatggactgg

SEQ ID NO: 22416 - DNA, 60 bp, Artificial Sequence
  Description of Artificial Sequence: Synthetic probe
gcgttaacctcgaatacagctaagaagatttataatacaatcgggaaggcagcggagcgt

SEQ ID NO: 22417 - DNA, 60 bp, Artificial Sequence
  Description of Artificial Sequence: Synthetic probe
atactgttttgatgagtcatcgaaaaggtatgagttacagtgtgtaggtgcgtgtgagcg

SEQ ID NO: 22418 - DNA, 60 bp, Artificial Sequence
  Description of Artificial Sequence: Synthetic probe
cgcgcagagagagggcgtcgaggaagaaaagacgtctgaggagccggcaagcattggaat

SEQ ID NO: 22419 - DNA, 60 bp, Artificial Sequence
  Description of Artificial Sequence: Synthetic probe
cgcgcagagagaaggcgtcgaggaagaaaagacgtctgaggagccggcacgcattggaat

SEQ ID NO: 22420 - DNA, 60 bp, Artificial Sequence
  Description of Artificial Sequence: Synthetic probe
gacgcgcacagagaaggtgtcgaggaagaaaagacgtctgaggagccggcacgcattgga

SEQ ID NO: 22421 - DNA, 60 bp, Artificial Sequence
  Description of Artificial Sequence: Synthetic probe
gaaatgcattgacgtcaaacacagtgaagaagatttattcaaccattgggaaagcagcgg

SEQ ID NO: 22422 - DNA, 60 bp, Artificial Sequence
  Description of Artificial Sequence: Synthetic probe
gaaggttggaaatgcattgacgtcaaacacagtgaagaagatttattcaaccattgggaa

SEQ ID NO: 22423 - DNA, 56 bp, Artificial Sequence
  Description of Artificial Sequence: Synthetic probe
gcgttaagatattaggcgagaaaatcgatatttccctcttcttacgaaatgcctga

SEQ ID NO: 22424 - DNA, 60 bp, Artificial Sequence
  Description of Artificial Sequence: Synthetic probe
gggaccactgcacttccaaagacgcgcaatcctgggggcactaaagtttggcgttaagat

SEQ ID NO: 22425 - DNA, 60 bp, Artificial Sequence
  Description of Artificial Sequence: Synthetic probe
gtatacgatgatgagctgcagatgcacatactacggggaccactgcacttccaaagacgc

SEQ ID NO: 22426 - DNA, 60 bp, Artificial Sequence
  Description of Artificial Sequence: Synthetic probe
aacgcccagagaattgtatacgatgatgagctgcagatgcacatactacggggaccactg

SEQ ID NO: 22427 - DNA, 50 bp, Artificial Sequence
  Description of Artificial Sequence: Synthetic probe
ggttcagcgcaggaggcgagtggtcggaccctgactgaggcgtacaaaga

SEQ ID NO: 22428 - DNA, 60 bp, Artificial Sequence
  Description of Artificial Sequence: Synthetic probe
attttgaagatttggcgagccattggcatgctctaggttcagcgcaggaggcgagtggtc

SEQ ID NO: 22429 - DNA, 60 bp, Artificial Sequence
  Description of Artificial Sequence: Synthetic probe
gaattgatgttgttcattttgaagatttggcgagccattggcatgctctaggttcagcgc

SEQ ID NO: 22430 - DNA, 60 bp, Artificial Sequence
  Description of Artificial Sequence: Synthetic probe
gattccaaggacgcagcagccgcatattcatatatattctgctccgtgggattctgatga

SEQ ID NO: 22431 - DNA, 60 bp, Artificial Sequence
  Description of Artificial Sequence: Synthetic probe
ggaagattgagggtgctaataaaaagtatatacatccaagggttatgatgaaatttaaga

SEQ ID NO: 22432 - DNA, 55 bp, Artificial Sequence
  Description of Artificial Sequence: Synthetic probe
acaaagacctagcgataggtgtgctgaacaagaggacgtcggttcttgacaatta

SEQ ID NO: 22433 - DNA, 60 bp, Artificial Sequence
  Description of Artificial Sequence: Synthetic probe
caactacgttagatcggcggttcggcgagatatcggacaaagacctagcgataggtgtgc

SEQ ID NO: 22434 - DNA, 60 bp, Artificial Sequence
  Description of Artificial Sequence: Synthetic probe
agcgcgttaagtggcatcgatttgtctcatatgcgcaccccaagggttgaaccgacaacc

SEQ ID NO: 22435 - DNA, 54 bp, Artificial Sequence
  Description of Artificial Sequence: Synthetic probe
gggcgggcgtggcggcgacaatcgcgacgggacgtgcaatcgagggcgcttaca

SEQ ID NO: 22436 - DNA, 60 bp, Artificial Sequence
  Description of Artificial Sequence: Synthetic probe
atgacagcggatgttcttgaggcgacatcagaagaagtgcccttggttggggcgggcgtg

SEQ ID NO: 22437 - DNA, 60 bp, Artificial Sequence
  Description of Artificial Sequence: Synthetic probe
ggtatgcaggaggaagcgattcaggaaattgcagggatgacagcggatgttcttgaggcg

SEQ ID NO: 22438 - DNA, 60 bp, Artificial Sequence
  Description of Artificial Sequence: Synthetic probe
gaagttgaacgtgatggtatgcaggaggaagcgattcaggaaattgcagggatgacagcg

SEQ ID NO: 22439 - DNA, 60 bp, Artificial Sequence
  Description of Artificial Sequence: Synthetic probe
cgatggtgaaggagtataggcaaaaaatcgatgctttaagggatgcaatagaagttgaac

SEQ ID NO: 22440 - DNA, 60 bp, Artificial Sequence
  Description of Artificial Sequence: Synthetic probe
cgcgcactacagcgtgaggcatctgaaagaagcgaaaatgagattacgatggtgaaggag

SEQ ID NO: 22441 - DNA, 60 bp, Artificial Sequence
  Description of Artificial Sequence: Synthetic probe
gatactcaaggcagaggagacgcaaatctcaaccctagcacgcgcactacagcgtgaggc

SEQ ID NO: 22442 - DNA, 60 bp, Artificial Sequence
  Description of Artificial Sequence: Synthetic probe
aactcatatgagaagatactcaaggcagaggagacgcaaatctcaaccctagcacgcgca

SEQ ID NO: 22443 - DNA, 60 bp, Artificial Sequence
  Description of Artificial Sequence: Synthetic probe
gaaatgatggagaagcgaaggaagagtatgagatactaaataaggctatcaactcatatg

SEQ ID NO: 22444 - DNA, 60 bp, Artificial Sequence
  Description of Artificial Sequence: Synthetic probe
gtttggggccgagctggatgagatctatcaatttatgactagcgcgatcagaaatgatgg

SEQ ID NO: 22445 - DNA, 60 bp, Artificial Sequence
  Description of Artificial Sequence: Synthetic probe
agggtagcgtacactcgctcgtaactggagaatcatacggcgagtcagtgaaacaagcag

SEQ ID NO: 22446 - DNA, 60 bp, Artificial Sequence
  Description of Artificial Sequence: Synthetic probe
cagcagaacgtttagccgagagtgagatcggatcggcgacaatagacggattattacagg

SEQ ID NO: 22447 - DNA, 52 bp, Artificial Sequence
  Description of Artificial Sequence: Synthetic probe
aaaagatttatgcgacaattggaagggcagcagaacgtttagccgagagtga

SEQ ID NO: 22448 - DNA, 60 bp, Artificial Sequence
  Description of Artificial Sequence: Synthetic probe
gttggacacgctgaagatacatctagcttctctatgctcagggcttgctgattcgatcgt

SEQ ID NO: 22449 - DNA, 60 bp, Artificial Sequence
  Description of Artificial Sequence: Synthetic probe
tccaagttggacacgctgaagatacatctagcttctctatgctcagggcttgctgattcg

SEQ ID NO: 22450 - DNA, 60 bp, Artificial Sequence
  Description of Artificial Sequence: Synthetic probe
cccggtgattctaagaagaaacaagatgccgatgacatgcataaagagtacggcgttgcc

SEQ ID NO: 22451 - DNA, 60 bp, Artificial Sequence
  Description of Artificial Sequence: Synthetic probe
tccatcccggtgattctaagaagaaacaagatgccgatgacatgcataaagagtacggcg

SEQ ID NO: 22452 - DNA, 60 bp, Artificial Sequence
  Description of Artificial Sequence: Synthetic probe
cgtatattataccctacgtcacgtgtatcgatggagcttgcggccggaatacggtcaacg

SEQ ID NO: 22453 - DNA, 60 bp, Artificial Sequence
  Description of Artificial Sequence: Synthetic probe
gacgggaacaggatataatggttgggcgacgattgatgtcgagtatagagaacctgcgcc

SEQ ID NO: 22454 - DNA, 60 bp, Artificial Sequence
  Description of Artificial Sequence: Synthetic probe
tcgagcagattttgcgacgggaacaggatataatggttgggcgacgattgatgtcgagta

SEQ ID NO: 22455 - DNA, 60 bp, Artificial Sequence
  Description of Artificial Sequence: Synthetic probe
tcgagcagatttcgcgacgggaacaggatataatggttgggcgacgattgatgtcgagta

SEQ ID NO: 22456 - DNA, 60 bp, Artificial Sequence
  Description of Artificial Sequence: Synthetic probe
tacgcatagtccactttgcacgggtgtgggttatgcgggtggtgtgtcggttgcaagaaa

SEQ ID NO: 22457 - DNA, 60 bp, Artificial Sequence
  Description of Artificial Sequence: Synthetic probe
tataaatgaagatttacattcggtattttcactgccggacgatatgtttaacgcgttact

SEQ ID NO: 22458 - DNA, 60 bp, Artificial Sequence
  Description of Artificial Sequence: Synthetic probe
tataaatgaagatttacattcagtattttcactgccggacgatatgtttaacgcgttact

SEQ ID NO: 22459 - DNA, 60 bp, Artificial Sequence
  Description of Artificial Sequence: Synthetic probe
cgcagaggacaggttgggtgaggagatagcttatgaaatgggtggtgcgttttccagtgc

SEQ ID NO: 22460 - DNA, 60 bp, Artificial Sequence
  Description of Artificial Sequence: Synthetic probe
cacgtatagctcgcaaatgcacgctcggaggatgatacgatcgaagactgtacaccccat

SEQ ID NO: 22461 - DNA, 60 bp, Artificial Sequence
  Description of Artificial Sequence: Synthetic probe
ttaataacacgtatagctcgcaaatgcacgctcggaggatgatacgatcgaagactgtac

SEQ ID NO: 22462 - DNA, 60 bp, Artificial Sequence
  Description of Artificial Sequence: Synthetic probe
cgactgtgttggatcataagtttaaggatattcctgatgagatgctcgcggtaagcgttt

SEQ ID NO: 22463 - DNA, 60 bp, Artificial Sequence
  Description of Artificial Sequence: Synthetic probe
atagtatcgactgtgttggatcataagtttaaggatattcctgatgagatgctcgcggta

SEQ ID NO: 22464 - DNA, 60 bp, Artificial Sequence
  Description of Artificial Sequence: Synthetic probe
cggcgagtcggtaaaacaagctgtgctattaaatgtaatgggaagtggtgaagagcttcc

SEQ ID NO: 22465 - DNA, 60 bp, Artificial Sequence
  Description of Artificial Sequence: Synthetic probe
gagagtcttacggcgagtcggtaaaacaagctgtgctattaaatgtaatgggaagtggtg

SEQ ID NO: 22466 - DNA, 60 bp, Artificial Sequence
  Description of Artificial Sequence: Synthetic probe
gggttagttcaggggagtgtacattcgttgatgacgggagagtcttacggcgagtcggta

SEQ ID NO: 22467 - DNA, 60 bp, Artificial Sequence
  Description of Artificial Sequence: Synthetic probe
agcggctattgatgggttagttcaggggagtgtacattcgttgatgacgggagagtctta

SEQ ID NO: 22468 - DNA, 59 bp, Artificial Sequence
  Description of Artificial Sequence: Synthetic probe
cggctgaacgatttgcagaaagtgaaatcggctcagcggctattgatgggttagttcag

SEQ ID NO: 22469 - DNA, 60 bp, Artificial Sequence
  Description of Artificial Sequence: Synthetic probe
gttaaaaaagttctctagttggcaactaccaaacatggagcgctttttgagaaaatacaa

SEQ ID NO: 22470 - DNA, 60 bp, Artificial Sequence
  Description of Artificial Sequence: Synthetic probe
gttaaaaaagttctctagttggcaaccaccaaacatggagcgctttttgagaaaatacaa

SEQ ID NO: 22471 - DNA, 60 bp, Artificial Sequence
  Description of Artificial Sequence: Synthetic probe
atacaatttctcagccgccaagatatgctccgagcgcgccaatgccatcatctatgccca

SEQ ID NO: 22472 - DNA, 60 bp, Artificial Sequence
  Description of Artificial Sequence: Synthetic probe
tgaaatgttgacaaagttgctaaatgtataactctcgtgacagagagttcgcacgctata

SEQ ID NO: 22473 - DNA, 60 bp, Artificial Sequence
  Description of Artificial Sequence: Synthetic probe
atttgggaacgatgaaatgttaacaaagttgctaaatgtataactctcgtgacagagagt

SEQ ID NO: 22474 - DNA, 60 bp, Artificial Sequence
  Description of Artificial Sequence: Synthetic probe
cgtatttgggaacgatgaaatgttaacaaagttgctaaatgtataactctcgtgacagag

SEQ ID NO: 22475 - DNA, 56 bp, Artificial Sequence
  Description of Artificial Sequence: Synthetic probe
cggaaatgatggaccagatcattcaggatggatggaaccatcgagattttaaaatg

SEQ ID NO: 22476 - DNA, 51 bp, Artificial Sequence
  Description of Artificial Sequence: Synthetic probe
cgcgagtgagccatgcgttatttaactgtacggtcaggttgcacgcgaaaa

SEQ ID NO: 22477 - DNA, 60 bp, Artificial Sequence
  Description of Artificial Sequence: Synthetic probe
cgcgagtgagccatgcgttatttaactgtacggtcaggttgcacgcgaaaaaagcggata

SEQ ID NO: 22478 - DNA, 60 bp, Artificial Sequence
  Description of Artificial Sequence: Synthetic probe
aacgcgagtgagccatgcgttatttaactgtacggttaggttgcacgcgaaaaaagcgga

SEQ ID NO: 22479 - DNA, 53 bp, Artificial Sequence
  Description of Artificial Sequence: Synthetic probe
aacgcgagtgagccatgcgttatttaactgtacggttaggttgcacgcgaaaa

SEQ ID NO: 22480 - DNA, 53 bp, Artificial Sequence
  Description of Artificial Sequence: Synthetic probe
aacgcgagtgagccatgcgttatttaactgtacggttaggctgcatgcgaaaa

SEQ ID NO: 22481 - DNA, 60 bp, Artificial Sequence
  Description of Artificial Sequence: Synthetic probe
ggagttaaaacagaggcagattcagattaacttggttaattgggcggagagtgagggcgg

SEQ ID NO: 22482 - DNA, 60 bp, Artificial Sequence
  Description of Artificial Sequence: Synthetic probe
ggagttaaaacagaggcagattcagattaacttggttgattgggcggagagtgagggcgg

SEQ ID NO: 22483 - DNA, 60 bp, Artificial Sequence
  Description of Artificial Sequence: Synthetic probe
gctaagacattatgcggggtgatcgcaaaacaaagttcacagccgtattgtcaaataaaa

SEQ ID NO: 22484 - DNA, 60 bp, Artificial Sequence
  Description of Artificial Sequence: Synthetic probe
gctaaaacattgtgcggggtgatcgcgaaacaaagttcacagccgtattgtcaaataaaa

SEQ ID NO: 22485 - DNA, 60 bp, Artificial Sequence
  Description of Artificial Sequence: Synthetic probe
ccaccaaggtatgccccgagtgccccgatgccatcatctatgccaacggttgcccttgaa

SEQ ID NO: 22486 - DNA, 60 bp, Artificial Sequence
  Description of Artificial Sequence: Synthetic probe
gttacctccaatctttccgccgaatgaccgggacagtgtactcacgattctgctactgtc

SEQ ID NO: 22487 - DNA, 60 bp, Artificial Sequence
  Description of Artificial Sequence: Synthetic probe
ccctcaaccagtaccccgcactaacggcagaaatatttaatgtgtacagctttagagacc

SEQ ID NO: 22488 - DNA, 60 bp, Artificial Sequence
  Description of Artificial Sequence: Synthetic probe
ggtacaaattcaggtggtgttttacgtttccatggataagaccctcaaccagtaccccgc

SEQ ID NO: 22489 - DNA, 60 bp, Artificial Sequence
  Description of Artificial Sequence: Synthetic probe
aaatgctatggtacaaattcaggtggtgttttacgtttccatggataagaccctcaacca

SEQ ID NO: 22490 - DNA, 60 bp, Artificial Sequence
  Description of Artificial Sequence: Synthetic probe
caccagtggtttgtggaccaaatatggttcaggtttcacttaatgctggagcgataggtg

SEQ ID NO: 22491 - DNA, 60 bp, Artificial Sequence
  Description of Artificial Sequence: Synthetic probe
gctactataggtgtgctggcaacgcctgagataccgttcacaactgaggcagcgaatgag

SEQ ID NO: 22492 - DNA, 60 bp, Artificial Sequence
  Description of Artificial Sequence: Synthetic probe
ggtgtcagcagcgggaataaatgtcggaccaatctcacccgattatacgcaacatatggc

SEQ ID NO: 22493 - DNA, 60 bp, Artificial Sequence
  Description of Artificial Sequence: Synthetic probe
tatgatggtgtcagcagcgggaataaatgtcggaccaatctcacccgattatacgcaaca

SEQ ID NO: 22494 - DNA, 60 bp, Artificial Sequence
  Description of Artificial Sequence: Synthetic probe
acaagaggcccgaattgtcctagaacccaatgtaatggagatactgggaatagcaatcaa

SEQ ID NO: 22495 - DNA, 60 bp, Artificial Sequence
  Description of Artificial Sequence: Synthetic probe
cagcaagagctctcactgtgatgcgggtatgtgctaccttacaagaggcccgaattgtcc

SEQ ID NO: 22496 - DNA, 60 bp, Artificial Sequence
  Description of Artificial Sequence: Synthetic probe
ttttacaacggaagcggcgaatgaaatagcacgggtgactggggagacttcgacatgggg

SEQ ID NO: 22497 - DNA, 60 bp, Artificial Sequence
  Description of Artificial Sequence: Synthetic probe
cctttcaagtgatatgagtgtggccttcaagataaatgggaccaaaacagaagtgcctcc

SEQ ID NO: 22498 - DNA, 60 bp, Artificial Sequence
  Description of Artificial Sequence: Synthetic probe
ggggaagaagcctcatggcgacgcgcagaaagagggtaccgaagaggagaagacgtctga

SEQ ID NO: 22499 - DNA, 60 bp, Artificial Sequence
  Description of Artificial Sequence: Synthetic probe
ggtttcctttaagctcgagacatgtcaaggggattgctttgatttcggtggataggaatc

SEQ ID NO: 22500 - DNA, 60 bp, Artificial Sequence
  Description of Artificial Sequence: Synthetic probe
gtacctgccaattacacatccctcgaaatgcttagtcgcctttgaggtagctgatgacgt

SEQ ID NO: 22501 - DNA, 53 bp, Artificial Sequence
  Description of Artificial Sequence: Synthetic probe
aagatcgtgagggatactaccgaggcaaggtggacgcttttcaaaataagatc

SEQ ID NO: 22502 - DNA, 60 bp, Artificial Sequence
  Description of Artificial Sequence: Synthetic probe
gggaaatcaaggttttagatctgtgtaggttgttgtctacgataggtaggaagatgtgca

SEQ ID NO: 22503 - DNA, 60 bp, Artificial Sequence
  Description of Artificial Sequence: Synthetic probe
gatgggtacgtactaccgagagtattagatatcacgctgaaagcctttgacgaccggaaa

SEQ ID NO: 22504 - DNA, 54 bp, Artificial Sequence
  Description of Artificial Sequence: Synthetic probe
gaatggaggaagatgggtagttctaacagaagagattgctcgcgcgatcgaatc

SEQ ID NO: 22505 - DNA, 60 bp, Artificial Sequence
  Description of Artificial Sequence: Synthetic probe
gaatggaggaagatgggtagttctaacagaagagatcgctcgcgcgatcgaatctaaata

SEQ ID NO: 22506 - DNA, 60 bp, Artificial Sequence
  Description of Artificial Sequence: Synthetic probe
gtaggtcatttgctttttacggcgggaggaagatttactaacctaactcaaaatatggct

SEQ ID NO: 22507 - DNA, 60 bp, Artificial Sequence
  Description of Artificial Sequence: Synthetic probe
gttgtaggtcatttgctttttacggcgggaggaagatttactaacctaactcaaaatatg

SEQ ID NO: 22508 - DNA, 60 bp, Artificial Sequence
  Description of Artificial Sequence: Synthetic probe
aaagctgcattcgcatcgtacgcagaagcgtttcgtgatgatgtgaggctgaggcagatc

SEQ ID NO: 22509 - DNA, 60 bp, Artificial Sequence
  Description of Artificial Sequence: Synthetic probe
atctttccgccgaatgatcgcgatagtgtactcacgatcctactactgtcaacgctcgca

SEQ ID NO: 22510 - DNA, 60 bp, Artificial Sequence
  Description of Artificial Sequence: Synthetic probe
ggtggtattctacgtttctatggataaaacgcttaaccagtaccctgcattgacggcaga

SEQ ID NO: 22511 - DNA, 60 bp, Artificial Sequence
  Description of Artificial Sequence: Synthetic probe
caaattcaggtggtattctacgtttctatggataaaacgcttaaccagtaccctgcattg

SEQ ID NO: 22512 - DNA, 60 bp, Artificial Sequence
  Description of Artificial Sequence: Synthetic probe
gacaggcagtactacaaattcacaatccgacccagcaaaatgctatggtgcaaattcagg

SEQ ID NO: 22513 - DNA, 60 bp, Artificial Sequence
  Description of Artificial Sequence: Synthetic probe
ggtaactcacagcgtacgctggctggtgtcactgtgagcgtgggtggtgtggacatgaga

SEQ ID NO: 22514 - DNA, 60 bp, Artificial Sequence
  Description of Artificial Sequence: Synthetic probe
ttctctatgccgcagggtaactcacagcgtacgctggctggtgtcactgtgagcgtgggt

SEQ ID NO: 22515 - DNA, 60 bp, Artificial Sequence
  Description of Artificial Sequence: Synthetic probe
ccgcaatgatcctatgatgatttatttagtctggagacggatcgagaatttctctatgcc

SEQ ID NO: 22516 - DNA, 60 bp, Artificial Sequence
  Description of Artificial Sequence: Synthetic probe
gccgcaatgatcctatgatgatttatttagtctggagacggatcgagaatttctctatgc

SEQ ID NO: 22517 - DNA, 60 bp, Artificial Sequence
  Description of Artificial Sequence: Synthetic probe
ttttccttgaaactgaagaggtttatcagcctggaagatggtttatgcgagccgctcaag

SEQ ID NO: 22518 - DNA, 60 bp, Artificial Sequence
  Description of Artificial Sequence: Synthetic probe
tgttaccggagagacttcaacttgggggccagcgcgccagccttacggttttttccttga

SEQ ID NO: 22519 - DNA, 60 bp, Artificial Sequence
  Description of Artificial Sequence: Synthetic probe
gtttacgtcgtgcagggtggttgacctcgcggcgtagattcccactgctgtataacgggg

SEQ ID NO: 22520 - DNA, 60 bp, Artificial Sequence
  Description of Artificial Sequence: Synthetic probe
catccgcgagtgatgatgaggttcaaaattcctagaacgcagcagccgcaaattcacatt

SEQ ID NO: 22521 - DNA, 60 bp, Artificial Sequence
  Description of Artificial Sequence: Synthetic probe
agataaagtgattcatccgcgagtgatgatgaggttcaaaattcctagaacgcagcagcc

SEQ ID NO: 22522 - DNA, 60 bp, Artificial Sequence
  Description of Artificial Sequence: Synthetic probe
agaagataaagtgattcatccgcgagtgatgatgaggttcaaaattcctagaacgcagca

SEQ ID NO: 22523 - DNA, 60 bp, Artificial Sequence
  Description of Artificial Sequence: Synthetic probe
gggcgggtcggataatcgcgtgggatggccaagccgcactacaagttcataacccaactc

SEQ ID NO: 22524 - DNA, 60 bp, Artificial Sequence
  Description of Artificial Sequence: Synthetic probe
cgacgaactgatgacgaaattactcaacgtttaggtcccttgacacggacctgtggcctc

SEQ ID NO: 22525 - DNA, 60 bp, Artificial Sequence
  Description of Artificial Sequence: Synthetic probe
ggaaacgacgaactgatgacgaaattactcaacgtttaggtcccttgacacggacctgtg

SEQ ID NO: 22526 - DNA, 60 bp, Artificial Sequence
  Description of Artificial Sequence: Synthetic probe
ctctcggtcggaactagtgttcccaaactactttgacaaatggataaactctcctatgtt

SEQ ID NO: 22527 - DNA, 60 bp, Artificial Sequence
  Description of Artificial Sequence: Synthetic probe
taaactctcggtcggaactagtgttcccaaactactttgacaaatggataaactctccta

SEQ ID NO: 22528 - DNA, 60 bp, Artificial Sequence
  Description of Artificial Sequence: Synthetic probe
ccgccttgactgcagagatatttaacgtctatagcttcagagaccatacctggcatggac

SEQ ID NO: 22529 - DNA, 60 bp, Artificial Sequence
  Description of Artificial Sequence: Synthetic probe
aatcaataccccgccttgactgcagagatatttaacgtctatagctttagagatcatact

SEQ ID NO: 22530 - DNA, 60 bp, Artificial Sequence
  Description of Artificial Sequence: Synthetic probe
gaatcaataccccgccttgactgcagagatatttaacgtctatagcttcagagatcatac

SEQ ID NO: 22531 - DNA, 60 bp, Artificial Sequence
  Description of Artificial Sequence: Synthetic probe
ctttgaatcaataccccgccttgactgcagagatatttaacgtctatagcttcagagatc

SEQ ID NO: 22532 - DNA, 60 bp, Artificial Sequence
  Description of Artificial Sequence: Synthetic probe
atggataagactttgaatcaataccccgccttgactgcagagatatttaacgtctatagc

SEQ ID NO: 22533 - DNA, 60 bp, Artificial Sequence
  Description of Artificial Sequence: Synthetic probe
tttcaatggataagactttgaatcaataccccgccttgactgcagagatatttaacgtct

SEQ ID NO: 22534 - DNA, 60 bp, Artificial Sequence
  Description of Artificial Sequence: Synthetic probe
cctttttctaagcgcacctgacatgcgagagtgggcagttaaggaaagcggtaacacgat

SEQ ID NO: 22535 - DNA, 51 bp, Artificial Sequence
  Description of Artificial Sequence: Synthetic probe
tatactaaggggacctttgcacttccagcgtcgagctattttaggggcgct

SEQ ID NO: 22536 - DNA, 60 bp, Artificial Sequence
  Description of Artificial Sequence: Synthetic probe
gcgtttcgcaccatcatcggaatgaatcttttttcctgggattcgatctaggaatcgatg

SEQ ID NO: 22537 - DNA, 60 bp, Artificial Sequence
  Description of Artificial Sequence: Synthetic probe
ggagcccgaagattgagcctactatcatagctacaacattggagcatcgatttaaagaga

SEQ ID NO: 22538 - DNA, 60 bp, Artificial Sequence
  Description of Artificial Sequence: Synthetic probe
gaggaggtgcccctaattggcgcgggtatggccacagctgtagcgaccggtagagcaata

SEQ ID NO: 22539 - DNA, 60 bp, Artificial Sequence
  Description of Artificial Sequence: Synthetic probe
agacgagcagcgaaatgaacttgttcgattaaagtataataaagagataacaaaggagtt

SEQ ID NO: 22540 - DNA, 60 bp, Artificial Sequence
  Description of Artificial Sequence: Synthetic probe
gcgagatcggtgcggcgacaatagatggcttagtgcagggtagcgttcattccataatta

SEQ ID NO: 22541 - DNA, 60 bp, Artificial Sequence
  Description of Artificial Sequence: Synthetic probe
cggtgggagatttagttacggtctttacgctaatgaacatcgagacacgtgtggctgaag

SEQ ID NO: 22542 - DNA, 60 bp, Artificial Sequence
  Description of Artificial Sequence: Synthetic probe
gcttacacgtgcgattgctcgcgccgcttacgcatagtccactttgcacgggtgtgggtt

SEQ ID NO: 22543 - DNA, 60 bp, Artificial Sequence
  Description of Artificial Sequence: Synthetic probe
ccgcttacacgtgcgattgctcgcgccgcttacgcatagtccactttgcacgggtgtggg

SEQ ID NO: 22544 - DNA, 54 bp, Artificial Sequence
  Description of Artificial Sequence: Synthetic probe
cttggcatattcgagcacgggtggagatactaagacggaattccttcatttaat

SEQ ID NO: 22545 - DNA, 60 bp, Artificial Sequence
  Description of Artificial Sequence: Synthetic probe
tttaagcatgataggtggtgttgagaggaagacggcgccgataggggcgcgggagagtgc

SEQ ID NO: 22546 - DNA, 60 bp, Artificial Sequence
  Description of Artificial Sequence: Synthetic probe
ttttaagcatgataggtggtgttgagaggaagacggcgccgataggggcgcgggagagtg

SEQ ID NO: 22547 - DNA, 60 bp, Artificial Sequence
  Description of Artificial Sequence: Synthetic probe
aaccactaaggtcggcataacaatcgaaggagttatgagtcaaaagaagcttttaagcat

SEQ ID NO: 22548 - DNA, 60 bp, Artificial Sequence
  Description of Artificial Sequence: Synthetic probe
ggagatcggaagcgtggaagaagtagccgggatagctcctcaaagaaggaaggtgttgga

SEQ ID NO: 22549 - DNA, 60 bp, Artificial Sequence
  Description of Artificial Sequence: Synthetic probe
gtggtgaaaggagatcggaagcgtggaagaagtagccgggatagctcctcaaagaaggaa

SEQ ID NO: 22550 - DNA, 60 bp, Artificial Sequence
  Description of Artificial Sequence: Synthetic probe
cagataatcgagatcgagcggagcttacaaaaggagctgggaatcacccgagagggagtg

SEQ ID NO: 22551 - DNA, 60 bp, Artificial Sequence
  Description of Artificial Sequence: Synthetic probe
cgaaagttgatgtttacagagatgaggcgtcagcgcagataatcgagatcgagcggagct

SEQ ID NO: 22552 - DNA, 60 bp, Artificial Sequence
  Description of Artificial Sequence: Synthetic probe
ggaggatgggtagtattaactgatgagatcgctcgcgcgattgaatctaaatacggtacg

SEQ ID NO: 22553 - DNA, 60 bp, Artificial Sequence
  Description of Artificial Sequence: Synthetic probe
gagcagaggaggatgggtagtattaactgatgagatcgctcgcgcgattgaatctaaata

SEQ ID NO: 22554 - DNA, 53 bp, Artificial Sequence
  Description of Artificial Sequence: Synthetic probe
ttaagcgatggtgagggggcacaacagaaggatggcaagaagaaagagagcag

SEQ ID NO: 22555 - DNA, 60 bp, Artificial Sequence
  Description of Artificial Sequence: Synthetic probe
agaaggaggaagaaccaaaactagaaggagagagtgaagaacaagacaaattaagcgatg

SEQ ID NO: 22556 - DNA, 60 bp, Artificial Sequence
  Description of Artificial Sequence: Synthetic probe
gattaaacgttcatccgaggggttaaaacagagacaaattcagattaatttagttgattg

SEQ ID NO: 22557 - DNA, 60 bp, Artificial Sequence
  Description of Artificial Sequence: Synthetic probe
gttaaaaaatcgcataggtcagctgcgatgctacttgcacccggtgacgtgattaaacgt

SEQ ID NO: 22558 - DNA, 60 bp, Artificial Sequence
  Description of Artificial Sequence: Synthetic probe
cggtgtagagagaaagatggctccaataggtgcgcgggagagcgcagttatgttagtttc

SEQ ID NO: 22559 - DNA, 51 bp, Artificial Sequence
  Description of Artificial Sequence: Synthetic probe
gaagagaagacgtctgaagaaccagcgaatatcgggatcactatagagggg

SEQ ID NO: 22560 - DNA, 60 bp, Artificial Sequence
  Description of Artificial Sequence: Synthetic probe
gcggtgcggggtgcagctgctcgaagattaccgtaaaagtgggatgatggatgaggccgt

SEQ ID NO: 22561 - DNA, 60 bp, Artificial Sequence
  Description of Artificial Sequence: Synthetic probe
gtacatccgatctttttaggatcaatgcattacgatattacatatgaagctttaaagaat

SEQ ID NO: 22562 - DNA, 60 bp, Artificial Sequence
  Description of Artificial Sequence: Synthetic probe
ggcagctagcagtgagtgtgttgaataagaggacagccgtaaccgataactgcaatgaaa

SEQ ID NO: 22563 - DNA, 60 bp, Artificial Sequence
  Description of Artificial Sequence: Synthetic probe
tcggcgcaggtatggccaccgctgtagcaaccggccgagcaatagaaggcgcatataaat

SEQ ID NO: 22564 - DNA, 60 bp, Artificial Sequence
  Description of Artificial Sequence: Synthetic probe
ttaatcggcgcaggtatggccaccgctgtagcaaccggccgagcaatagaaggcgcatat

SEQ ID NO: 22565 - DNA, 60 bp, Artificial Sequence
  Description of Artificial Sequence: Synthetic probe
tgaccgctgacgtcttagaagcagcttcggaggaggtgcccttaatcggcgcaggtatgg

SEQ ID NO: 22566 - DNA, 60 bp, Artificial Sequence
  Description of Artificial Sequence: Synthetic probe
ttgctggaatgaccgctgacgtcttagaagcagcttcggaggaggtgcccttaatcggcg

SEQ ID NO: 22567 - DNA, 60 bp, Artificial Sequence
  Description of Artificial Sequence: Synthetic probe
cggtgcggcagcaatagacggtttggtgcagggcagtgtcatttccataattacaggtga

SEQ ID NO: 22568 - DNA, 60 bp, Artificial Sequence
  Description of Artificial Sequence: Synthetic probe
aaatcggtgcggcagcaatagacggtttggtgcagggcagtgtcatttccataattacag

SEQ ID NO: 22569 - DNA, 60 bp, Artificial Sequence
  Description of Artificial Sequence: Synthetic probe
cagcagagataccgccgtggtttaaaagtctaaatcccatgcttggagtggtgaacttgg

SEQ ID NO: 22570 - DNA, 60 bp, Artificial Sequence
  Description of Artificial Sequence: Synthetic probe
cgtcaatcccgctggatggtttcgaaatgccgttaacctaaggacagtaggtagagtggc

SEQ ID NO: 22571 - DNA, 55 bp, Artificial Sequence
  Description of Artificial Sequence: Synthetic probe
atgggaccaaaacagaagtgcctccatggtttaaaggccttaatccaatgttagg

SEQ ID NO: 22572 - DNA, 60 bp, Artificial Sequence
  Description of Artificial Sequence: Synthetic probe
atgggaccaaaacagaagtgcctccatggtttaaaggccttaatccaatgttaggcgtcg

SEQ ID NO: 22573 - DNA, 60 bp, Artificial Sequence
  Description of Artificial Sequence: Synthetic probe
aagaaaagatgaaacataatcaagatagggttgaagagctgagtttagtgcgtgtggatg

SEQ ID NO: 22574 - DNA, 60 bp, Artificial Sequence
  Description of Artificial Sequence: Synthetic probe
ctcaaccaccaagatatgctccaagtgcgccgatgccatcatccatgccaacggttgccc

SEQ ID NO: 22575 - DNA, 60 bp, Artificial Sequence
  Description of Artificial Sequence: Synthetic probe
agacgcttaaccagtaccctgcactaacggcagagatatttaatgtgtacagctttagag

SEQ ID NO: 22576 - DNA, 60 bp, Artificial Sequence
  Description of Artificial Sequence: Synthetic probe
cgacacccgagataccattcacaactgaggcggcaaatgagattgctcgtgttactggag

SEQ ID NO: 22577 - DNA, 60 bp, Artificial Sequence
  Description of Artificial Sequence: Synthetic probe
gcgacacccgagataccattcacaactgaggcggcaaatgagattgctcgtgttactgga

SEQ ID NO: 22578 - DNA, 60 bp, Artificial Sequence
  Description of Artificial Sequence: Synthetic probe
aggaatagcaatcaatagatataatggactgactctacgcggagttacgatgagaccaac

SEQ ID NO: 22579 - DNA, 60 bp, Artificial Sequence
  Description of Artificial Sequence: Synthetic probe
gatcgagaatttcgcgatggctcaagggaattcacaacaaacgctggccgccgtgactgt

SEQ ID NO: 22580 - DNA, 60 bp, Artificial Sequence
  Description of Artificial Sequence: Synthetic probe
ggccgtaactgctgtggtgtgtggccagacaatgatccaagtgtcattgaatgctggagc

SEQ ID NO: 22581 - DNA, 60 bp, Artificial Sequence
  Description of Artificial Sequence: Synthetic probe
aggccgtaactgctgtggtgtgtggccagacaatgatccaagtgtcattgaatgctggag

SEQ ID NO: 22582 - DNA, 60 bp, Artificial Sequence
  Description of Artificial Sequence: Synthetic probe
tatggactataacgtttggatctggacactcaggtgctattgggtcatatacgtgccata

SEQ ID NO: 22583 - DNA, 60 bp, Artificial Sequence
  Description of Artificial Sequence: Synthetic probe
ccgcatcggcccccggttgggggaacaagtaggtcgaaatgcagtgatactcgtcttttg

SEQ ID NO: 22584 - DNA, 60 bp, Artificial Sequence
  Description of Artificial Sequence: Synthetic probe
cgcgaccgtgatacaattcgaccattttgcgcacatcgcgtgaaacaactttcgtcacgg

SEQ ID NO: 22585 - DNA, 60 bp, Artificial Sequence
  Description of Artificial Sequence: Synthetic probe
gaaatctaccacgatcgcgaccgtgatacaattcgaccattttgcgcacatcgcgtgaaa

SEQ ID NO: 22586 - DNA, 60 bp, Artificial Sequence
  Description of Artificial Sequence: Synthetic probe
cgaactaattacgaaactcgcaaatctatgagcccttgacaaggctccctcgcggcttca

SEQ ID NO: 22587 - DNA, 60 bp, Artificial Sequence
  Description of Artificial Sequence: Synthetic probe
tcggcaacgtttggagtgagaaacatagtaaagtgagaatatgtcgaaggaattttctaa

SEQ ID NO: 22588 - DNA, 50 bp, Artificial Sequence
  Description of Artificial Sequence: Synthetic probe
agcccagcgcagcatgccgcgagagcaaaacgtagattccgtgggacgcg

SEQ ID NO: 22589 - DNA, 60 bp, Artificial Sequence
  Description of Artificial Sequence: Synthetic probe
ccggttcgaatgactaagtatattgcatgtgatttagcgtttggtagcggatgtggtgga

SEQ ID NO: 22590 - DNA, 60 bp, Artificial Sequence
  Description of Artificial Sequence: Synthetic probe
gctatgaccggacgctcacttacacaaggttcgctgggagagtgggcatcttttgtgtgc

SEQ ID NO: 22591 - DNA, 60 bp, Artificial Sequence
  Description of Artificial Sequence: Synthetic probe
tgtgggggctcatcgatcagctatttacacagagaatggagttatcatatgatcgtagtc

SEQ ID NO: 22592 - DNA, 60 bp, Artificial Sequence
  Description of Artificial Sequence: Synthetic probe
cgcgacgcgatggacgatgatggcgagtgcgtttcctaccagcgtcagattagtgaaggg

SEQ ID NO: 22593 - DNA, 60 bp, Artificial Sequence
  Description of Artificial Sequence: Synthetic probe
cacgacggaggaggcgacacagcttgctaaggcaataaggagtaatgttggcgcgacgcg

SEQ ID NO: 22594 - DNA, 60 bp, Artificial Sequence
  Description of Artificial Sequence: Synthetic probe
ctatcatcttccaaagacggagtacatagagcgagaagaggaggtgagtcagtatgaggg

SEQ ID NO: 22595 - DNA, 60 bp, Artificial Sequence
  Description of Artificial Sequence: Synthetic probe
ggtcgccggaagcacagagcgagaaccaatgtgcactgaaggtatatgcggatgaggcgg

SEQ ID NO: 22596 - DNA, 60 bp, Artificial Sequence
  Description of Artificial Sequence: Synthetic probe
cacaagagcaggctatctcaagttaccacgaacacattaggtcgccggaagcacagagcg

SEQ ID NO: 22597 - DNA, 60 bp, Artificial Sequence
  Description of Artificial Sequence: Synthetic probe
cataagaagattaaaataacagaggctgagattgcaacttcatggagtgatgacccatgg

SEQ ID NO: 22598 - DNA, 60 bp, Artificial Sequence
  Description of Artificial Sequence: Synthetic probe
ggagccgttagctgaaccagacgtcaagtccggtcgtgtgtgtatgacgtcgacagaatc

SEQ ID NO: 22599 - DNA, 60 bp, Artificial Sequence
  Description of Artificial Sequence: Synthetic probe
gaatcgcgtttagatcctggaacccgcataatcaattggttggtagtaagggagccgtta

SEQ ID NO: 22600 - DNA, 60 bp, Artificial Sequence
  Description of Artificial Sequence: Synthetic probe
tttccattggagtttacgtcctacatatgctacccggaaggagattgatcgcgaacgaag

SEQ ID NO: 22601 - DNA, 60 bp, Artificial Sequence
  Description of Artificial Sequence: Synthetic probe
cgaggaacgatcattgcgtgtgagatggaactaggggacgtctacgaaactttaagatca

SEQ ID NO: 22602 - DNA, 60 bp, Artificial Sequence
  Description of Artificial Sequence: Synthetic probe
gttggcgcatatggtggagtaatccgtacccctgcttacgaggaacgatcattgcgtgtg

SEQ ID NO: 22603 - DNA, 60 bp, Artificial Sequence
  Description of Artificial Sequence: Synthetic probe
cctttgaagaaattctatgccttgttagcgattgccgcgactgacagctatcgttggcgc

SEQ ID NO: 22604 - DNA, 60 bp, Artificial Sequence
  Description of Artificial Sequence: Synthetic probe
cgagttgggaatagcgaatatgatacaattcaggctatccagagtggacaaacgcctttg

SEQ ID NO: 22605 - DNA, 60 bp, Artificial Sequence
  Description of Artificial Sequence: Synthetic probe
tcgtgtcatcaattggacgtcagatgtggaatagtgaggaattgccggtcgatgatgcaa

SEQ ID NO: 22606 - DNA, 60 bp, Artificial Sequence
  Description of Artificial Sequence: Synthetic probe
ccgtgatggatggattcgagctactatacagcccaaaatagtcgaggagttgagacggag

SEQ ID NO: 22607 - DNA, 60 bp, Artificial Sequence
  Description of Artificial Sequence: Synthetic probe
tgcacgctgaagctaacgcagaaacacgagatcaactcatcgtaaatggggtgtataccg

SEQ ID NO: 22608 - DNA, 60 bp, Artificial Sequence
  Description of Artificial Sequence: Synthetic probe
ccaggtatcgaagaccgcgggatacactttgaagcaaacgtatcgattaactgtgcacgc

SEQ ID NO: 22609 - DNA, 60 bp, Artificial Sequence
  Description of Artificial Sequence: Synthetic probe
cggaaacagttggctacgattatgcaccggtgccgaaagtgggatgcgatcatgggaatg

SEQ ID NO: 22610 - DNA, 60 bp, Artificial Sequence
  Description of Artificial Sequence: Synthetic probe
gtggtaagttaaagtttaaaatgctaacggggttggtgaagctagattcgaattatgcgg

SEQ ID NO: 22611 - DNA, 60 bp, Artificial Sequence
  Description of Artificial Sequence: Synthetic probe
cggatgattctggcagaatggcggatcacaatatagatgtgtgggttaagaagcggttgg

SEQ ID NO: 22612 - DNA, 60 bp, Artificial Sequence
  Description of Artificial Sequence: Synthetic probe
attcgggcgtatgatagaaagcacaaaattgcgttagacaaacgtacggatgattctggc

SEQ ID NO: 22613 - DNA, 60 bp, Artificial Sequence
  Description of Artificial Sequence: Synthetic probe
ctcggggaattttcgttcgtgctgagggcatacgagtcgcattaaattcaagaccagaca

SEQ ID NO: 22614 - DNA, 60 bp, Artificial Sequence
  Description of Artificial Sequence: Synthetic probe
gaatgtgtggatgatgtaaatgggaagacggatgtgtcgaagctggaggaaactcgggga

SEQ ID NO: 22615 - DNA, 60 bp, Artificial Sequence
  Description of Artificial Sequence: Synthetic probe
gttaaaagttgcgaggatggaggattttccgatatgcgtaattgaacgcgagtccaagtt

SEQ ID NO: 22616 - DNA, 60 bp, Artificial Sequence
  Description of Artificial Sequence: Synthetic probe
gcgatgatgaacatcctaagactcatatcacaaaggagtatatcgagaaggtcgcgaagc

SEQ ID NO: 22617 - DNA, 60 bp, Artificial Sequence
  Description of Artificial Sequence: Synthetic probe
ggtgaagacgctagcgatgatgaacatcctaagactcatatcacaaaggagtatatcgag

SEQ ID NO: 22618 - DNA, 60 bp, Artificial Sequence
  Description of Artificial Sequence: Synthetic probe
gagatcatgctaatcatcaatccgatgaggatgaacagggtgaagacgctagcgatgatg

SEQ ID NO: 22619 - DNA, 60 bp, Artificial Sequence
  Description of Artificial Sequence: Synthetic probe
taagagtgaacgtgagatggcaccgcgctcgcagatccagagcgcggcgccaagggagga

SEQ ID NO: 22620 - DNA, 60 bp, Artificial Sequence
  Description of Artificial Sequence: Synthetic probe
ttatgactattttcccctcgaagatagaactaagaagtgcaaccatacgaatcttgaact

SEQ ID NO: 22621 - DNA, 60 bp, Artificial Sequence
  Description of Artificial Sequence: Synthetic probe
gccgtgtgaagtagaggtgggtgagcgtaagaatatcgatccctatgtaaagcggacgca

SEQ ID NO: 22622 - DNA, 60 bp, Artificial Sequence
  Description of Artificial Sequence: Synthetic probe
catcaccacgcgaatgaatcattttttattggatttgacttaggcatcgacctggttcac

SEQ ID NO: 22623 - DNA, 60 bp, Artificial Sequence
  Description of Artificial Sequence: Synthetic probe
aatgggaagtggtgaagagcttccagatccactaagcccgggtgaacgtggaatgcagac

SEQ ID NO: 22624 - DNA, 60 bp, Artificial Sequence
  Description of Artificial Sequence: Synthetic probe
aatgcctgggccgctcacacgtgctattgcacgcgccgcctatgtgtagtccactttgca

SEQ ID NO: 22625 - DNA, 60 bp, Artificial Sequence
  Description of Artificial Sequence: Synthetic probe
atgccagggccgctcacacgtgctattgcacgcgccgcctatgtgtagtccactttgcac

SEQ ID NO: 22626 - DNA, 60 bp, Artificial Sequence
  Description of Artificial Sequence: Synthetic probe
taaatccgatgccggggccgctcacacgtgctattgcacgcgccgcctatgtgtagtcca

SEQ ID NO: 22627 - DNA, 60 bp, Artificial Sequence
  Description of Artificial Sequence: Synthetic probe
caaaacggcgaagttatcaatttagctgttcgtatgtcgcagatgtgggctgagcactag

SEQ ID NO: 22628 - DNA, 60 bp, Artificial Sequence
  Description of Artificial Sequence: Synthetic probe
gaggctgtgggatttggaatagtcagggatggcaggaaggcgttttcatgcttggacgcg

SEQ ID NO: 22629 - DNA, 60 bp, Artificial Sequence
  Description of Artificial Sequence: Synthetic probe
agcaggttggaagacaaggagatcattattacacgtcacattgctacacaggggcggaag

SEQ ID NO: 22630 - DNA, 60 bp, Artificial Sequence
  Description of Artificial Sequence: Synthetic probe
ttgagagttggatttgctgaagaagggaggtatgtacaacagctttttggggttgttccg

SEQ ID NO: 22631 - DNA, 60 bp, Artificial Sequence
  Description of Artificial Sequence: Synthetic probe
ctataaccccgacgcagccgaggattggattgacccaagcttgtttgaaatcaggggtgc

SEQ ID NO: 22632 - DNA, 60 bp, Artificial Sequence
  Description of Artificial Sequence: Synthetic probe
tgggatgatgaatgaagcgatgaaacaatcggcattggctgactctgaaagaataagatt

SEQ ID NO: 22633 - DNA, 60 bp, Artificial Sequence
  Description of Artificial Sequence: Synthetic probe
gtgactgatgcggatgagccgcggaaagcgatgaaattggctgaattggcagaagaagcg

SEQ ID NO: 22634 - DNA, 60 bp, Artificial Sequence
  Description of Artificial Sequence: Synthetic probe
gttatagaggcctcaaaacataacagcttccacacggatgtggactgggtgcaatggatg

SEQ ID NO: 22635 - DNA, 60 bp, Artificial Sequence
  Description of Artificial Sequence: Synthetic probe
tgttatagaggcctcaaaacataacagcttccacacggatgtggactgggtgcaatggat

SEQ ID NO: 22636 - DNA, 60 bp, Artificial Sequence
  Description of Artificial Sequence: Synthetic probe
ccaaggatcgtcgacattagcctaaaagggtatgatattagaaagtctgttatagaggcc

SEQ ID NO: 22637 - DNA, 60 bp, Artificial Sequence
  Description of Artificial Sequence: Synthetic probe
ttaccaaggatcgtcgacattagcctaaaagggtatgatattagaaagtctgttatagag

SEQ ID NO: 22638 - DNA, 59 bp, Artificial Sequence
  Description of Artificial Sequence: Synthetic probe
gtacgcattcgatatcagagatgaggggattcgcgacgcgtttaagtataatcctgtgc

SEQ ID NO: 22639 - DNA, 60 bp, Artificial Sequence
  Description of Artificial Sequence: Synthetic probe
gccaagatggccgacatgacgtatctaagattccagagatgtacgcattcgatatcagag

SEQ ID NO: 22640 - DNA, 60 bp, Artificial Sequence
  Description of Artificial Sequence: Synthetic probe
gttaaaacaggatcgcgatggatgagttcgctattccaatttatggacgtggctatcccg

SEQ ID NO: 22641 - DNA, 60 bp, Artificial Sequence
  Description of Artificial Sequence: Synthetic probe
cacgtcgtatatggaggtccaatccatatccctgtctacggggcacgttgattgcagcgg

SEQ ID NO: 22642 - DNA, 60 bp, Artificial Sequence
  Description of Artificial Sequence: Synthetic probe
aagagagcagcaaagaggctaaagatgcagatgtggatagacgcatacatactgcagtgg

SEQ ID NO: 22643 - DNA, 59 bp, Artificial Sequence
  Description of Artificial Sequence: Synthetic probe
aagagagcagcaaagaggctaaagatgcagatgtggatagacgcatacatactgcagtg

SEQ ID NO: 22644 - DNA, 60 bp, Artificial Sequence
  Description of Artificial Sequence: Synthetic probe
gtgggccgatacactttcagaggcgagcgatcctaggagctttgaaatttggatgtaagg

SEQ ID NO: 22645 - DNA, 60 bp, Artificial Sequence
  Description of Artificial Sequence: Synthetic probe
gcacgcaaatgcatacgagaagattggttaggtcaaaaacagtacatccaatttacttag

SEQ ID NO: 22646 - DNA, 60 bp, Artificial Sequence
  Description of Artificial Sequence: Synthetic probe
gaagatcttaccgcccattggcatgcattgggagcagcacaaacagcggcaggacggaca

SEQ ID NO: 22647 - DNA, 60 bp, Artificial Sequence
  Description of Artificial Sequence: Synthetic probe
atgagatattaccgaggtttaagaaagcgatggatgaagaaaaggagatatgcgggatag

SEQ ID NO: 22648 - DNA, 60 bp, Artificial Sequence
  Description of Artificial Sequence: Synthetic probe
gcatttgcgcactccgaagatcgaacctagcgttgtttcaactatccttgagtaccgtac

SEQ ID NO: 22649 - DNA, 60 bp, Artificial Sequence
  Description of Artificial Sequence: Synthetic probe
attggcgcggggatggctacggctgtggcgacaggtagggctatagagggagcgtataag

SEQ ID NO: 22650 - DNA, 60 bp, Artificial Sequence
  Description of Artificial Sequence: Synthetic probe
agaggtagagagagatggcatgcaagaggaggcgatacaagagattgcggggatgaccgc

SEQ ID NO: 22651 - DNA, 60 bp, Artificial Sequence
  Description of Artificial Sequence: Synthetic probe
aatatgttggggaatggcgaggaaatccctgatccactaagcccgggggagcgagggata

SEQ ID NO: 22652 - DNA, 60 bp, Artificial Sequence
  Description of Artificial Sequence: Synthetic probe
gcgagtcttacggcgaatctgtgaaacaagctgtgttgttaaatatgttggggaatggcg

SEQ ID NO: 22653 - DNA, 60 bp, Artificial Sequence
  Description of Artificial Sequence: Synthetic probe
ggctcagcggcgatcgatgggttggtacagggaagcgtacattcaatcataacaggcgag

SEQ ID NO: 22654 - DNA, 58 bp, Artificial Sequence
  Description of Artificial Sequence: Synthetic probe
ttgtatcgtatgaagtggttgattctacgatgcaaactcctactgctgtataacgggg

SEQ ID NO: 22655 - DNA, 60 bp, Artificial Sequence
  Description of Artificial Sequence: Synthetic probe
aaggtttgtatcgtatgaagtggttgattctacgatgcaaactcctactgctgtataacg

SEQ ID NO: 22656 - DNA, 60 bp, Artificial Sequence
  Description of Artificial Sequence: Synthetic probe
gagtctgaatccgatgctgggggtggtgaatcttggtgcaacctttataatgatggtttg

SEQ ID NO: 22657 - DNA, 60 bp, Artificial Sequence
  Description of Artificial Sequence: Synthetic probe
ggctgttgttgcactgctaacatcggtttgtaccctgtccagcgatatgagtgtggcgtt

SEQ ID NO: 22658 - DNA, 60 bp, Artificial Sequence
  Description of Artificial Sequence: Synthetic probe
aagagggcgattatacatatgacgctgttagtcgcggctgttgttgcactgctaacatcg

SEQ ID NO: 22659 - DNA, 60 bp, Artificial Sequence
  Description of Artificial Sequence: Synthetic probe
ggtggtctaaagaagaagagggcgattatacatatgacgctgttagtcgcggctgttgtt

SEQ ID NO: 22660 - DNA, 60 bp, Artificial Sequence
  Description of Artificial Sequence: Synthetic probe
atgaacaaattttaccaaagctgaagagtgatttaggtggtctaaagaagaagagggcga

SEQ ID NO: 22661 - DNA, 60 bp, Artificial Sequence
  Description of Artificial Sequence: Synthetic probe
ttaagcgccatgtcaatgaacaaattttaccaaagctgaagagtgatttaggtggtctaa

SEQ ID NO: 22662 - DNA, 60 bp, Artificial Sequence
  Description of Artificial Sequence: Synthetic probe
gggttgaagaactaagtttggttcgtgtcgatgatacgatttcacagccgccaaggtatg

SEQ ID NO: 22663 - DNA, 60 bp, Artificial Sequence
  Description of Artificial Sequence: Synthetic probe
aacataatcaggaaagggttgaagaactaagtttggttcgtgtcgatgatacgatttcac

SEQ ID NO: 22664 - DNA, 58 bp, Artificial Sequence
  Description of Artificial Sequence: Synthetic probe
tggacttgcagtcatctaaaaaggaattgtttattcaatgggatgtgtgttaaacaaa

SEQ ID NO: 22665 - DNA, 60 bp, Artificial Sequence
  Description of Artificial Sequence: Synthetic probe
ctccgcagttctatatacagaagatgatgattggcccacgggttagctcgcgagtgcgga

SEQ ID NO: 22666 - DNA, 60 bp, Artificial Sequence
  Description of Artificial Sequence: Synthetic probe
ctccgcagttctatatacagaagatgatgattggcccacgagttagctcacgagtacgga

SEQ ID NO: 22667 - DNA, 60 bp, Artificial Sequence
  Description of Artificial Sequence: Synthetic probe
ttatctccgcagttctatatacagaagatgatgattggcccacgggttagctcgcgagtg

SEQ ID NO: 22668 - DNA, 60 bp, Artificial Sequence
  Description of Artificial Sequence: Synthetic probe
acttatctccgcagttctatatacagaagatgatgattggcccacgagttagctcacgag

SEQ ID NO: 22669 - DNA, 60 bp, Artificial Sequence
  Description of Artificial Sequence: Synthetic probe
aggaattgtctatttaatggaatgtgtgtcaagcagcattttgagagagcgatgatcgcg

SEQ ID NO: 22670 - DNA, 60 bp, Artificial Sequence
  Description of Artificial Sequence: Synthetic probe
aaggaattgtctatttaatggaatgtgcgtcaagcagcattttgagagagcgatgatcgc

SEQ ID NO: 22671 - DNA, 52 bp, Artificial Sequence
  Description of Artificial Sequence: Synthetic probe
ttcagagagaagtcaagacgagatcaaaatggtaaaggagtacagacagaag

SEQ ID NO: 22672 - DNA, 60 bp, Artificial Sequence
  Description of Artificial Sequence: Synthetic probe
caatatcaccagattacacgcagcatatggcgacgattggagtgctagcaacgccagaga

SEQ ID NO: 22673 - DNA, 60 bp, Artificial Sequence
  Description of Artificial Sequence: Synthetic probe
agtttgcgattcacggtgtaaatccaatgcctggtccgcttacacgtgcgattgctcgcg

SEQ ID NO: 22674 - DNA, 60 bp, Artificial Sequence
  Description of Artificial Sequence: Synthetic probe
cagttttgagacctgagtttgcgattcacggtgtaaatccaatgcctggtccgcttacac

SEQ ID NO: 22675 - DNA, 58 bp, Artificial Sequence
  Description of Artificial Sequence: Synthetic probe
ccccaatcttcccgccaaatgatcgggacagtgtacttacgattctactgttgtcgac

SEQ ID NO: 22676 - DNA, 60 bp, Artificial Sequence
  Description of Artificial Sequence: Synthetic probe
aaatatgttacccccaatcttcccgccaaatgatcgggacagtgtacttacgattctact

SEQ ID NO: 22677 - DNA, 60 bp, Artificial Sequence
  Description of Artificial Sequence: Synthetic probe
ggcaggcggtgctacaaattcacaatccaactcagcaaaacgctatggtgcaaattcagg

SEQ ID NO: 22678 - DNA, 60 bp, Artificial Sequence
  Description of Artificial Sequence: Synthetic probe
gatcctatgatgatttacttagtttggagacggatcgagaatttctctatgccacagggt

SEQ ID NO: 22679 - DNA, 58 bp, Artificial Sequence
  Description of Artificial Sequence: Synthetic probe
tggtttgtggaccggatatggttcaggtttcactgaacgcgggcgcgagaggtgacgt

SEQ ID NO: 22680 - DNA, 60 bp, Artificial Sequence
  Description of Artificial Sequence: Synthetic probe
cctggaaggtggtttatgcgagctgctcaagtcgttactccagtggtttgtggaccggat

SEQ ID NO: 22681 - DNA, 60 bp, Artificial Sequence
  Description of Artificial Sequence: Synthetic probe
aggaattaacgttggcccaatttcacctgactatacgcaacatatggctactataggcgt

SEQ ID NO: 22682 - DNA, 60 bp, Artificial Sequence
  Description of Artificial Sequence: Synthetic probe
atgcgggcatgtgccactttacaggaagcaagaattgttctagaagctaatgtgatggaa

SEQ ID NO: 22683 - DNA, 60 bp, Artificial Sequence
  Description of Artificial Sequence: Synthetic probe
ctttctgcaatgccttacatctacgtgccaatcaataatggtcaaattgttaatccgaca

SEQ ID NO: 22684 - DNA, 60 bp, Artificial Sequence
  Description of Artificial Sequence: Synthetic probe
ggatgattcactttctgcaatgccttacatctacgtgccaatcaataatggtcaaattgt

SEQ ID NO: 22685 - DNA, 60 bp, Artificial Sequence
  Description of Artificial Sequence: Synthetic probe
tttcaaaagcttttcccaaccatacgaggaagatgtcgaagggaagatgaagcgatgcgg

SEQ ID NO: 22686 - DNA, 60 bp, Artificial Sequence
  Description of Artificial Sequence: Synthetic probe
atgcattatcactctatgctatgcggagaaggttcacttcgctgggttcgcagcgcctgc

SEQ ID NO: 22687 - DNA, 60 bp, Artificial Sequence
  Description of Artificial Sequence: Synthetic probe
aagggccggagctcagcgaagatgaggatgagagagcttatgctacgatgtttgaaatgg

SEQ ID NO: 22688 - DNA, 60 bp, Artificial Sequence
  Description of Artificial Sequence: Synthetic probe
atgctcgccattcaagacggtaaagattgaagaacatgtaggaaatgattcagtttttaa

SEQ ID NO: 22689 - DNA, 57 bp, Artificial Sequence
  Description of Artificial Sequence: Synthetic probe
atgctcgccattcaagacggtaaagattgaagaacatgtaggaaatgattcagtttt

SEQ ID NO: 22690 - DNA, 60 bp, Artificial Sequence
  Description of Artificial Sequence: Synthetic probe
cctgtggtgtgattgatgtacgtgcatcagagctgactggatgctcgccattcaagacgg

SEQ ID NO: 22691 - DNA, 60 bp, Artificial Sequence
  Description of Artificial Sequence: Synthetic probe
ctacctatgattattgtccgtgagggattggatcatccggatcggtgggaatggcttatt

SEQ ID NO: 22692 - DNA, 50 bp, Artificial Sequence
  Description of Artificial Sequence: Synthetic probe
gattcagctgatcaattttctgaggatggatgactttgcgaaacatttta

SEQ ID NO: 22693 - DNA, 60 bp, Artificial Sequence
  Description of Artificial Sequence: Synthetic probe
gaagaggatgtcgaaggaaagatgaagcggtgtggagtgcaactccttgaggattaccgc

SEQ ID NO: 22694 - DNA, 60 bp, Artificial Sequence
  Description of Artificial Sequence: Synthetic probe
ccatacgaagaggatgtcgaaggaaagatgaagcggtgtggagtgcaactccttgaggat

SEQ ID NO: 22695 - DNA, 60 bp, Artificial Sequence
  Description of Artificial Sequence: Synthetic probe
gaagtcggagatgagaagcagtttgatatctttagtaaggcagttaattcatacaataag

SEQ ID NO: 22696 - DNA, 60 bp, Artificial Sequence
  Description of Artificial Sequence: Synthetic probe
gaagaagtcggagatgagaagcagtttgatatctttagtaaggcagttaattcatacaat

SEQ ID NO: 22697 - DNA, 60 bp, Artificial Sequence
  Description of Artificial Sequence: Synthetic probe
gggcaccaagctggctgcgccaactgtgtagatgtgcgaccaatctatgcacttggtagc

SEQ ID NO: 22698 - DNA, 60 bp, Artificial Sequence
  Description of Artificial Sequence: Synthetic probe
tgggcaccaagctggctgcgccaactgtgtagatgtgcgaccaatctatgcacttggtag

SEQ ID NO: 22699 - DNA, 51 bp, Artificial Sequence
  Description of Artificial Sequence: Synthetic probe
gaggccgtgaagcaatccgcattggtcaattcggaaagagttagattggat

SEQ ID NO: 22700 - DNA, 51 bp, Artificial Sequence
  Description of Artificial Sequence: Synthetic probe
atagcttcagagatcatacatggcacgggttgaggacggccatactaaata

SEQ ID NO: 22701 - DNA, 60 bp, Artificial Sequence
  Description of Artificial Sequence: Synthetic probe
tacaagttgtgttttatatttccatggataagactttgaaccaataccccgccttgactg

SEQ ID NO: 22702 - DNA, 60 bp, Artificial Sequence
  Description of Artificial Sequence: Synthetic probe
ggttcagatacaagttgtgttttatatttccatggataagactttgaaccaataccccgc

SEQ ID NO: 22703 - DNA, 51 bp, Artificial Sequence
  Description of Artificial Sequence: Synthetic probe
tggggcaagaggagatgtgcagcagatatttcaaggtcgtaatgatcccat

SEQ ID NO: 22704 - DNA, 60 bp, Artificial Sequence
  Description of Artificial Sequence: Synthetic probe
cggaggagacttttcaacctgggagatggtttatgcgtgccgctcaagcagtgacagcgg

SEQ ID NO: 22705 - DNA, 60 bp, Artificial Sequence
  Description of Artificial Sequence: Synthetic probe
cccaacatatggctacaatcggtgtactagcgacgcctgagataccttttacaacagaag

SEQ ID NO: 22706 - DNA, 60 bp, Artificial Sequence
  Description of Artificial Sequence: Synthetic probe
tggatatgatgctgtctgcggctgggataaacgttgggccgatatccccagattataccc

SEQ ID NO: 22707 - DNA, 51 bp, Artificial Sequence
  Description of Artificial Sequence: Synthetic probe
aactttacgaggggtgacgatgcgcccaacctcgttagcgcagagaaatga

SEQ ID NO: 22708 - DNA, 60 bp, Artificial Sequence
  Description of Artificial Sequence: Synthetic probe
tacaggttgtgttttacatttccatggataagaccttgaatcaatatcctgccttgactg

SEQ ID NO: 22709 - DNA, 60 bp, Artificial Sequence
  Description of Artificial Sequence: Synthetic probe
ggttcagatacaggttgtgttttacatttccatggataagaccttgaatcaatatcctgc

SEQ ID NO: 22710 - DNA, 60 bp, Artificial Sequence
  Description of Artificial Sequence: Synthetic probe
gtagatatgcgggcagggcgcatcattgcgtgggatggacaggccgctctacatgtacac

SEQ ID NO: 22711 - DNA, 60 bp, Artificial Sequence
  Description of Artificial Sequence: Synthetic probe
agcgttggcggagtagatatgcgggcagggcgcatcattgcgtgggatggacaggccgct

SEQ ID NO: 22712 - DNA, 60 bp, Artificial Sequence
  Description of Artificial Sequence: Synthetic probe
cgcgatggcgcaaggtaactcacagcaaacccaagcaggtgtaactgttagcgttggcgg

SEQ ID NO: 22713 - DNA, 60 bp, Artificial Sequence
  Description of Artificial Sequence: Synthetic probe
tcgcgatggcgcaaggtaactcacagcaaacccaagcaggtgtaactgttagcgttggcg

SEQ ID NO: 22714 - DNA, 60 bp, Artificial Sequence
  Description of Artificial Sequence: Synthetic probe
ttacaacggaggcggcgaatgagattgctcgcgtgacaggtgagacttcgacgtggggac

SEQ ID NO: 22715 - DNA, 60 bp, Artificial Sequence
  Description of Artificial Sequence: Synthetic probe
accctttacaacggaggcggcgaatgagattgctcgcgtgacaggtgagacttcgacgtg

SEQ ID NO: 22716 - DNA, 60 bp, Artificial Sequence
  Description of Artificial Sequence: Synthetic probe
tagatatgatgctgtctgctgctgggataaacgtaggaccgatatccccagattataccc

SEQ ID NO: 22717 - DNA, 60 bp, Artificial Sequence
  Description of Artificial Sequence: Synthetic probe
ctggggcgcatcagaacgctgacccagtcgtgctagatgtgagctggatatcgctgtggt

SEQ ID NO: 22718 - DNA, 60 bp, Artificial Sequence
  Description of Artificial Sequence: Synthetic probe
cagttgtgctagatgtgagttggatatcattgtggtttgctttcaacagatcgtttgaac

SEQ ID NO: 22719 - DNA, 59 bp, Artificial Sequence
  Description of Artificial Sequence: Synthetic probe
gtatattgaagcggtgcagttacaagagttgaggaactcaattgggtggttagaaaggt

SEQ ID NO: 22720 - DNA, 60 bp, Artificial Sequence
  Description of Artificial Sequence: Synthetic probe
gctgcagaacaagtgtacaaaatcgttaaagttcccagtatttcattcagacacatcgta

SEQ ID NO: 22721 - DNA, 52 bp, Artificial Sequence
  Description of Artificial Sequence: Synthetic probe
tgattatatgacggcaacacgagaggttgattttacagtgccggatgtacaa

SEQ ID NO: 22722 - DNA, 60 bp, Artificial Sequence
  Description of Artificial Sequence: Synthetic probe
gcgtgactgttagcgttggtggagtagatatgcgggcggggcgtatcatagcgtgggatg

SEQ ID NO: 22723 - DNA, 60 bp, Artificial Sequence
  Description of Artificial Sequence: Synthetic probe
cggcaaagagactaaagatgcagatgtggatagacgcgtacatactgcagtgggatctgg

SEQ ID NO: 22724 - DNA, 60 bp, Artificial Sequence
  Description of Artificial Sequence: Synthetic probe
ggcggcaaagagactaaagatgcagatgtggatagacgcgtacatactgcagtgggatct

SEQ ID NO: 22725 - DNA, 60 bp, Artificial Sequence
  Description of Artificial Sequence: Synthetic probe
gtcctcctcgcagccagctagtcgctatcctcagcaggcaccatgctcgatcgctcatta

SEQ ID NO: 22726 - DNA, 60 bp, Artificial Sequence
  Description of Artificial Sequence: Synthetic probe
gatcaatgtccccgaataccttatcaaaccttacaatgctttgtcctcctcgcagccagc

SEQ ID NO: 22727 - DNA, 60 bp, Artificial Sequence
  Description of Artificial Sequence: Synthetic probe
ccagatcttactggtacatctaaatcctacgtacggtcgttgtagcaggtgtgtctccca

SEQ ID NO: 22728 - DNA, 60 bp, Artificial Sequence
  Description of Artificial Sequence: Synthetic probe
tcaagggtgtttcagtcacgaacacaggttacattctagtcggagtcgggttgattgcag

SEQ ID NO: 22729 - DNA, 60 bp, Artificial Sequence
  Description of Artificial Sequence: Synthetic probe
accaatgccccgtcgtagaagtaggcggtgtaaccatccaggtcgggagcagggagtact

SEQ ID NO: 22730 - DNA, 60 bp, Artificial Sequence
  Description of Artificial Sequence: Synthetic probe
ccggagggcactatctgcagtcaaaatgcaatatacccgatgagcccattgctccaagaa

SEQ ID NO: 22731 - DNA, 60 bp, Artificial Sequence
  Description of Artificial Sequence: Synthetic probe
caaggctaagataacctatgtggatatcgaaagttacttcattgtgctcagcatagctta

SEQ ID NO: 22732 - DNA, 60 bp, Artificial Sequence
  Description of Artificial Sequence: Synthetic probe
cctcagggacccggtctcggctgagctttctattcaggccttaagttacgccttgggtgg

SEQ ID NO: 22733 - DNA, 60 bp, Artificial Sequence
  Description of Artificial Sequence: Synthetic probe
aatgaactggtgcctgcgatgggccagctatcgtgtgaaattgtgggtcaaaagctaggg

SEQ ID NO: 22734 - DNA, 60 bp, Artificial Sequence
  Description of Artificial Sequence: Synthetic probe
ggagtcgtagggacaggtagtgccagttataaggtgatgacccaatcgagtcaccagtca

SEQ ID NO: 22735 - DNA, 60 bp, Artificial Sequence
  Description of Artificial Sequence: Synthetic probe
gcatggggatcttatttgctgccctgctagcaatgactaacccacacttagctactggcc

SEQ ID NO: 22736 - DNA, 60 bp, Artificial Sequence
  Description of Artificial Sequence: Synthetic probe
gcaaccaaggcactgctcaacaaacatgcccagaccacctacaaaggacctagcatgggg

SEQ ID NO: 22737 - DNA, 60 bp, Artificial Sequence
  Description of Artificial Sequence: Synthetic probe
gaccccgccaaccgggagccccagacccccaaatccatccgggcatcaaatcacggcaga

SEQ ID NO: 22738 - DNA, 60 bp, Artificial Sequence
  Description of Artificial Sequence: Synthetic probe
caggcccgccccatgcacagcaacagaacacccccagatcccccaccaaaagcccccccg

SEQ ID NO: 22739 - DNA, 60 bp, Artificial Sequence
  Description of Artificial Sequence: Synthetic probe
gcagggcccaaagcccgggcccaccccacgagcagggcggaaccaaggggcaggcccgcc

SEQ ID NO: 22740 - DNA, 60 bp, Artificial Sequence
  Description of Artificial Sequence: Synthetic probe
gagaactctatgggaggacttaatttcggcagatcttattttgaccctgcatatttccgg

SEQ ID NO: 22741 - DNA, 60 bp, Artificial Sequence
  Description of Artificial Sequence: Synthetic probe
ggcggcacccaaagggtctttcccgccttagtcattttccgagcccgtgactgatcttcc

SEQ ID NO: 22742 - DNA, 60 bp, Artificial Sequence
  Description of Artificial Sequence: Synthetic probe
aagcctaccatgtcaacaaaggtctggagtgcatcaaagcccttagggctcgacctctcg

SEQ ID NO: 22743 - DNA, 58 bp, Artificial Sequence
  Description of Artificial Sequence: Synthetic probe
aagcctaccatgtcaacaaaggtctggagtgcatcaaagcccttagggctagacccct

SEQ ID NO: 22744 - DNA, 60 bp, Artificial Sequence
  Description of Artificial Sequence: Synthetic probe
gaaatgattctggcggttcaaggtgttcaggattatatcaacaatgagctggtgccggcg

SEQ ID NO: 22745 - DNA, 60 bp, Artificial Sequence
  Description of Artificial Sequence: Synthetic probe
acaagcaggccaggaaatgattctggcggttcaaggtgttcaggattatatcaacaatga

SEQ ID NO: 22746 - DNA, 59 bp, Artificial Sequence
  Description of Artificial Sequence: Synthetic probe
tcatcagtcaatgatgaattctcaggccatcgaaggtcttaaggcaagtctggaaacaa

SEQ ID NO: 22747 - DNA, 60 bp, Artificial Sequence
  Description of Artificial Sequence: Synthetic probe
cagcggggattgcccttcatcagtcaatgatgaattctcaggccatcgaaggtcttaagg

SEQ ID NO: 22748 - DNA, 60 bp, Artificial Sequence
  Description of Artificial Sequence: Synthetic probe
ggctggtgcagctctcggagttgcaaccgcagcccagattacagcagggattgctcttca

SEQ ID NO: 22749 - DNA, 60 bp, Artificial Sequence
  Description of Artificial Sequence: Synthetic probe
tgttttggctggtgcagctctcggagttgcaaccgcagcccagattacagcggggattgc

SEQ ID NO: 22750 - DNA, 60 bp, Artificial Sequence
  Description of Artificial Sequence: Synthetic probe
ctcactatcaaatttggtatagaaactatgtacccagcactgggcctgcatgaattcgcc

SEQ ID NO: 22751 - DNA, 60 bp, Artificial Sequence
  Description of Artificial Sequence: Synthetic probe
gaccctgatatcagcattaaattggtggaggtaatccaaagtgacaaaactcagtcaggg

SEQ ID NO: 22752 - DNA, 60 bp, Artificial Sequence
  Description of Artificial Sequence: Synthetic probe
gaccctgatatcagcattaaattggtggaggtagtccaaagtgataaaactcagtcaggg

SEQ ID NO: 22753 - DNA, 60 bp, Artificial Sequence
  Description of Artificial Sequence: Synthetic probe
ggttgaattagagaactctatgggaggacttaatttcggcagatcttattttgaccctgc

SEQ ID NO: 22754 - DNA, 50 bp, Artificial Sequence
  Description of Artificial Sequence: Synthetic probe
acaaattcagtgcaggagcataccccttgttgtggagctatgctatgggg

SEQ ID NO: 22755 - DNA, 60 bp, Artificial Sequence
  Description of Artificial Sequence: Synthetic probe
cagaataagttcagtgcaggagcataccccttgttgtggagctatgctatgggggttggg

SEQ ID NO: 22756 - DNA, 60 bp, Artificial Sequence
  Description of Artificial Sequence: Synthetic probe
cagaacaaattcagtgcaggagcataccccttgttgtggagctatgctatgggggtcggg

SEQ ID NO: 22757 - DNA, 54 bp, Artificial Sequence
  Description of Artificial Sequence: Synthetic probe
cagaacaaattcagtgcaggagcataccccttgttgtggagctatgctatgggg

SEQ ID NO: 22758 - DNA, 60 bp, Artificial Sequence
  Description of Artificial Sequence: Synthetic probe
gcccctgatactgcagctgattcagagttacggaggtgggtgaaatacactcagcaaagg

SEQ ID NO: 22759 - DNA, 60 bp, Artificial Sequence
  Description of Artificial Sequence: Synthetic probe
gagattcaagacattgaggtccaggatccagaagggttcaatatgatactggcaaccatc

SEQ ID NO: 22760 - DNA, 60 bp, Artificial Sequence
  Description of Artificial Sequence: Synthetic probe
gttgcatgaggaccaacaagctataattaccagattagagtcactgctttcgctcaaggg

SEQ ID NO: 22761 - DNA, 60 bp, Artificial Sequence
  Description of Artificial Sequence: Synthetic probe
gcaggattgctaggattcaggcggtcttgcaaccatcagtccctcaggagttccgtatct

SEQ ID NO: 22762 - DNA, 60 bp, Artificial Sequence
  Description of Artificial Sequence: Synthetic probe
ccaggcatcaagcactgggttacagtgttatcatgtttatgatcacagcggtgatgcggt

SEQ ID NO: 22763 - DNA, 60 bp, Artificial Sequence
  Description of Artificial Sequence: Synthetic probe
gaccctaacatcttatgtacactggcgatcagggctccgaataacgctctattgtagtgc

SEQ ID NO: 22764 - DNA, 60 bp, Artificial Sequence
  Description of Artificial Sequence: Synthetic probe
acactgccggctaactaagggttcactctcattaactaggtcctgagcccctagcctttc

SEQ ID NO: 22765 - DNA, 60 bp, Artificial Sequence
  Description of Artificial Sequence: Synthetic probe
actaaaactgtttagtcgcaccctacagtttcccagctaacgtggttagtccggtttttg

SEQ ID NO: 22766 - DNA, 60 bp, Artificial Sequence
  Description of Artificial Sequence: Synthetic probe
cctcgagctaagcctcgtatgcggagcgtagggttgtaccgtctttaaatactaaaactg

SEQ ID NO: 22767 - DNA, 60 bp, Artificial Sequence
  Description of Artificial Sequence: Synthetic probe
agtcacttctgtcagcggagtccagcgttgagatcacctaggggcccatgcctcgagcta

SEQ ID NO: 22768 - DNA, 60 bp, Artificial Sequence
  Description of Artificial Sequence: Synthetic probe
agatgcacgagtctctttcgaggttctgtggcaagagtcacttctgtcagcggagtccag

SEQ ID NO: 22769 - DNA, 60 bp, Artificial Sequence
  Description of Artificial Sequence: Synthetic probe
cgccttgatagtcgatgtgagcgtaaatatggatcattataattctggctgtatgtctgc

SEQ ID NO: 22770 - DNA, 60 bp, Artificial Sequence
  Description of Artificial Sequence: Synthetic probe
ggtctgttcaagatactctaaaatctctagaagttaacgccttgatagtcgatgtgagcg

SEQ ID NO: 22771 - DNA, 60 bp, Artificial Sequence
  Description of Artificial Sequence: Synthetic probe
cctccgtacctcaagatttccgagtttaccgagacgtgatcattgaagatgaccaaggtc

SEQ ID NO: 22772 - DNA, 60 bp, Artificial Sequence
  Description of Artificial Sequence: Synthetic probe
gggagctttggcgtagtaagtgcaagatcgtgaggattcaggcggttctgcaaccctccg

SEQ ID NO: 22773 - DNA, 60 bp, Artificial Sequence
  Description of Artificial Sequence: Synthetic probe
gcatctttgctacccactcatggacattaacgaggatctgaatcgggagctttggcgtag

SEQ ID NO: 22774 - DNA, 60 bp, Artificial Sequence
  Description of Artificial Sequence: Synthetic probe
cacattcgggctaccggcaagatgtcaaaaactttatgggccctcgagggctttaagaag

SEQ ID NO: 22775 - DNA, 60 bp, Artificial Sequence
  Description of Artificial Sequence: Synthetic probe
agaaaatggggctggtttttgcattagggggaataggtgggactagcttacacattcggg

SEQ ID NO: 22776 - DNA, 60 bp, Artificial Sequence
  Description of Artificial Sequence: Synthetic probe
gcggaagaaaacagatatgtacagcgcggattattgtaagcccaagatcgagaaaatggg

SEQ ID NO: 22777 - DNA, 60 bp, Artificial Sequence
  Description of Artificial Sequence: Synthetic probe
tctgagcatcttcttgtagcaacgttcatggtccatatagggaactttcagcggaagaaa

SEQ ID NO: 22778 - DNA, 60 bp, Artificial Sequence
  Description of Artificial Sequence: Synthetic probe
tgacgatccggttcgaacaatcgccaatagaacattggcgcatcctgaactctgagcatc

SEQ ID NO: 22779 - DNA, 60 bp, Artificial Sequence
  Description of Artificial Sequence: Synthetic probe
ggccagagtttaggtcgatgaatgcaattgcttttaactcgctggtgacgatccggttcg

SEQ ID NO: 22780 - DNA, 60 bp, Artificial Sequence
  Description of Artificial Sequence: Synthetic probe
cccgactcagtgacaacggagggtacgatatcccgcgtcattggccagagtttaggtcga

SEQ ID NO: 22781 - DNA, 60 bp, Artificial Sequence
  Description of Artificial Sequence: Synthetic probe
tacatgagcataacccgactcagtgacaacggagggtacgatatcccgcgtcattggcca

SEQ ID NO: 22782 - DNA, 60 bp, Artificial Sequence
  Description of Artificial Sequence: Synthetic probe
tcccattggacttctaccaaaggtttagagtagtgtacatgagcataacccgactcagtg

SEQ ID NO: 22783 - DNA, 60 bp, Artificial Sequence
  Description of Artificial Sequence: Synthetic probe
catccggatctgtgtttaatgccaatcaggtgtgcgaaactgtcaaccttatcccattgg

SEQ ID NO: 22784 - DNA, 60 bp, Artificial Sequence
  Description of Artificial Sequence: Synthetic probe
gaacagctagtattctacgataactcgcccctgaaggtattgaccccctggaagaaagtg

SEQ ID NO: 22785 - DNA, 60 bp, Artificial Sequence
  Description of Artificial Sequence: Synthetic probe
gcgttggacggtcaacagcccgtccggaggaattgctgaaagaggccactatcctcgaca

SEQ ID NO: 22786 - DNA, 60 bp, Artificial Sequence
  Description of Artificial Sequence: Synthetic probe
tgacccgctaagtcccccgataggtagaacatttggctcgttaccgctcggcgttggacg

SEQ ID NO: 22787 - DNA, 60 bp, Artificial Sequence
  Description of Artificial Sequence: Synthetic probe
aaagacgagtgctttagttatatcttcctgtggggattgtcggaagacagtgacccgcta

SEQ ID NO: 22788 - DNA, 60 bp, Artificial Sequence
  Description of Artificial Sequence: Synthetic probe
gccgattgattccccaagtgagagtaattgatccaggactcggggtacggaaagacgagt

SEQ ID NO: 22789 - DNA, 60 bp, Artificial Sequence
  Description of Artificial Sequence: Synthetic probe
ggatgtcaaagggtcgattcaaccaatcggcccaaaaacatacagtgacggccgattgat

SEQ ID NO: 22790 - DNA, 60 bp, Artificial Sequence
  Description of Artificial Sequence: Synthetic probe
cagagttacggaggtgggtgaaatacactcaacaaaggagggtgattggagaattcaggc

SEQ ID NO: 22791 - DNA, 60 bp, Artificial Sequence
  Description of Artificial Sequence: Synthetic probe
cagccgactcagagttacggaggtgggtgaaatacactcaacaaaggagggtgatcggag

SEQ ID NO: 22792 - DNA, 60 bp, Artificial Sequence
  Description of Artificial Sequence: Synthetic probe
ccggaagggttcaatatgatactggcaaccatcttagcccagatctggattttactggct

SEQ ID NO: 22793 - DNA, 53 bp, Artificial Sequence
  Description of Artificial Sequence: Synthetic probe
gcaagtctggaaacaaccaatcaagcaattgaggaaatacgacaagcgggtca

SEQ ID NO: 22794 - DNA, 60 bp, Artificial Sequence
  Description of Artificial Sequence: Synthetic probe
gctgttctcggatatccaagacatcaaagcagcactagccaaattgcatgaggatcaaca

SEQ ID NO: 22795 - DNA, 60 bp, Artificial Sequence
  Description of Artificial Sequence: Synthetic probe
gctgttctcggatatccaagacatcaaagcagctctagctaaattgcatgaggaccaaca

SEQ ID NO: 22796 - DNA, 60 bp, Artificial Sequence
  Description of Artificial Sequence: Synthetic probe
tgagctgttctcggatatccaagacatcaaagcagcactagccaaattgcatgaggatca

SEQ ID NO: 22797 - DNA, 60 bp, Artificial Sequence
  Description of Artificial Sequence: Synthetic probe
cccagacggtaatgttgtatctcgcagtgtgatccgctcaatcatcaagtcaagtcatct

SEQ ID NO: 22798 - DNA, 60 bp, Artificial Sequence
  Description of Artificial Sequence: Synthetic probe
cccggacgacagtgtcgcatctcgcagtgtgatccgctcaatcatcaagtcaagtcatct

SEQ ID NO: 22799 - DNA, 56 bp, Artificial Sequence
  Description of Artificial Sequence: Synthetic probe
atgaggatcaacaagttataattaccagattagagtcactgctttcgctcaagggg

SEQ ID NO: 22800 - DNA, 60 bp, Artificial Sequence
  Description of Artificial Sequence: Synthetic probe
gaggcctgtcgagacaaaccgccacccttctgtaacagtacagattgggagccactagag

SEQ ID NO: 22801 - DNA, 60 bp, Artificial Sequence
  Description of Artificial Sequence: Synthetic probe
tcaggtcgtggctacaacatttcatctatgatcacaatcactgaggaaggcatgtacggg

SEQ ID NO: 22802 - DNA, 60 bp, Artificial Sequence
  Description of Artificial Sequence: Synthetic probe
ggaactcgcaagcaggtcacccatacaggggcagtagggattgagatcacttgcaatagc

SEQ ID NO: 22803 - DNA, 60 bp, Artificial Sequence
  Description of Artificial Sequence: Synthetic probe
tagaaacctccaatatgtgtcagcaacctacgacacctctagagttgagcatgccattgt

SEQ ID NO: 22804 - DNA, 60 bp, Artificial Sequence
  Description of Artificial Sequence: Synthetic probe
tgggtcgtccctgtgacgagaacagatgaccaaaggaaaatgggacagtgccgccgagag

SEQ ID NO: 22805 - DNA, 60 bp, Artificial Sequence
  Description of Artificial Sequence: Synthetic probe
atatgacaaactacctggagctcccaagacagccggaattggagatctgcatgctagctc

SEQ ID NO: 22806 - DNA, 60 bp, Artificial Sequence
  Description of Artificial Sequence: Synthetic probe
accgacatcattagtcaacttggggaggagctgtaccgggtccacaacgtctaaaggtca

SEQ ID NO: 22807 - DNA, 60 bp, Artificial Sequence
  Description of Artificial Sequence: Synthetic probe
gacgacaagcattgatattaccaagtctattgagcaccaggtcaaggacgtcttaactcc

SEQ ID NO: 22808 - DNA, 60 bp, Artificial Sequence
  Description of Artificial Sequence: Synthetic probe
ccccaagagacagggtcaatgccttctacaaagacaacctccaatttaaggacactcgag

SEQ ID NO: 22809 - DNA, 60 bp, Artificial Sequence
  Description of Artificial Sequence: Synthetic probe
ccttctgtaacagtacagattgggagccactagaggccggccgaatacctgcttatggag

SEQ ID NO: 22810 - DNA, 60 bp, Artificial Sequence
  Description of Artificial Sequence: Synthetic probe
ccaccacccttctgtaacagtacagattgggagccactagaggccggccgaatacctgct

SEQ ID NO: 22811 - DNA, 60 bp, Artificial Sequence
  Description of Artificial Sequence: Synthetic probe
cgagacaaaccgccacccttctgtaacagtacagattgggagccactagaggccggccga

SEQ ID NO: 22812 - DNA, 60 bp, Artificial Sequence
  Description of Artificial Sequence: Synthetic probe
ctcgggtcgtggctacaacatttcatctatgatcacaatcactgaagaaggcatgtacgg

SEQ ID NO: 22813 - DNA, 60 bp, Artificial Sequence
  Description of Artificial Sequence: Synthetic probe
ccgaggatcgctgaaatgatctgtgacattgatacctacatagtggaggcaggattggcc

SEQ ID NO: 22814 - DNA, 60 bp, Artificial Sequence
  Description of Artificial Sequence: Synthetic probe
gcaatcccaggaggtgcccgactatcaggggcctacagccagtggagaaatgtgccatca

SEQ ID NO: 22815 - DNA, 60 bp, Artificial Sequence
  Description of Artificial Sequence: Synthetic probe
caccaccttaaggcgaacgaaactattgtgtcatctcacttctttgtctactccaagggg

SEQ ID NO: 22816 - DNA, 60 bp, Artificial Sequence
  Description of Artificial Sequence: Synthetic probe
cagagaccagggctctccacagtgataagaccgagcaccataaagcgacatacagacagc

SEQ ID NO: 22817 - DNA, 60 bp, Artificial Sequence
  Description of Artificial Sequence: Synthetic probe
cctcagcgtgactactgttcccgaacaccccagtgtaccctacgatgccttgtcctcctc

SEQ ID NO: 22818 - DNA, 60 bp, Artificial Sequence
  Description of Artificial Sequence: Synthetic probe
ccctcctccaaaaccacaaccccagacacccaaccagagccaacacaggaaggaaaccac

SEQ ID NO: 22819 - DNA, 60 bp, Artificial Sequence
  Description of Artificial Sequence: Synthetic probe
aactaagctcgtcacaacacagctgatctcctcgcttccacccagcctagctacaacctg

SEQ ID NO: 22820 - DNA, 60 bp, Artificial Sequence
  Description of Artificial Sequence: Synthetic probe
aacttaggacccaggtctacagatccgtccacctcgaaacaacccgcctcagcagccgac

SEQ ID NO: 22821 - DNA, 60 bp, Artificial Sequence
  Description of Artificial Sequence: Synthetic probe
ggagggtaatcggggagttcaggcttgacaagggatggcttgacacagtgcgcaacagga

SEQ ID NO: 22822 - DNA, 60 bp, Artificial Sequence
  Description of Artificial Sequence: Synthetic probe
agtggttttggctggtgcagctctcggagttgcaaccgcagcccagatcacagcagggat

SEQ ID NO: 22823 - DNA, 60 bp, Artificial Sequence
  Description of Artificial Sequence: Synthetic probe
tcgagagaaaccaccacctttctgtaacagtacagattgggagccattagaggccggccg

SEQ ID NO: 22824 - DNA, 60 bp, Artificial Sequence
  Description of Artificial Sequence: Synthetic probe
ccgcctagaggcttgtcgagagaaaccaccacctttctgtaacagtacagattgggagcc

SEQ ID NO: 22825 - DNA, 60 bp, Artificial Sequence
  Description of Artificial Sequence: Synthetic probe
ccgccgagaggcttgtcgagagaaaccaccacctttctgtaacagtacagattgggagcc

SEQ ID NO: 22826 - DNA, 60 bp, Artificial Sequence
  Description of Artificial Sequence: Synthetic probe
gtgccgccaagaggcttgtcgagacaaaccaccacctttctgtaacagtacagattgggg

SEQ ID NO: 22827 - DNA, 60 bp, Artificial Sequence
  Description of Artificial Sequence: Synthetic probe
gcaagattgccaggattcaggcggtcctacaaccatctgtccctcaggagttccgtatct

SEQ ID NO: 22828 - DNA, 57 bp, Artificial Sequence
  Description of Artificial Sequence: Synthetic probe
ggggacgagcctccacataagaagtaccggcaaaatgagcaagacactccacgcaca

SEQ ID NO: 22829 - DNA, 60 bp, Artificial Sequence
  Description of Artificial Sequence: Synthetic probe
cctacgacatctctagaattgaacatgccattgtgtactacatctacagtactgggcggt

SEQ ID NO: 22830 - DNA, 60 bp, Artificial Sequence
  Description of Artificial Sequence: Synthetic probe
caaaacattagcatatctaccatagaaggccatctttctagtatcatgatcgcgatcccg

SEQ ID NO: 22831 - DNA, 60 bp, Artificial Sequence
  Description of Artificial Sequence: Synthetic probe
cagccgactcagagttacggaggtgggtgaaatacactcaacaaaggagggtaattggag

SEQ ID NO: 22832 - DNA, 60 bp, Artificial Sequence
  Description of Artificial Sequence: Synthetic probe
cagccgaatcagagttacggaggtgggtgaaatacactcaacaaaggagggtaattggag

SEQ ID NO: 22833 - DNA, 60 bp, Artificial Sequence
  Description of Artificial Sequence: Synthetic probe
cgggagcatttccttcgggatcaaattcgccaggatccacatcgctgttctcagattcct

SEQ ID NO: 22834 - DNA, 60 bp, Artificial Sequence
  Description of Artificial Sequence: Synthetic probe
ggaggagatgaagaatctgagaacagcgatgtggatcctggcgaacctgatcccgaggga

SEQ ID NO: 22835 - DNA, 60 bp, Artificial Sequence
  Description of Artificial Sequence: Synthetic probe
gtgcactaattcgggagtgattcagcaattgcctgcctcctgaccccgatctggtcaaca

SEQ ID NO: 22836 - DNA, 60 bp, Artificial Sequence
  Description of Artificial Sequence: Synthetic probe
agagaccgattgctgcgtgattcctatggtagatcacccgagaatcccaagcctgcatga

SEQ ID NO: 22837 - DNA, 60 bp, Artificial Sequence
  Description of Artificial Sequence: Synthetic probe
ggaagtcatttgccggtgtgaggttcggttgcttcatgcccctgagtttagacagtgacc

SEQ ID NO: 22838 - DNA, 60 bp, Artificial Sequence
  Description of Artificial Sequence: Synthetic probe
atccggcagaagctcataacccagggccatccacagtgacgagactaagcaccgcaaagc

SEQ ID NO: 22839 - DNA, 60 bp, Artificial Sequence
  Description of Artificial Sequence: Synthetic probe
cccacgtgaccactgccctcggacacctcagcaaaccccactatgctctgtcctcctcac

SEQ ID NO: 22840 - DNA, 60 bp, Artificial Sequence
  Description of Artificial Sequence: Synthetic probe
taggggagtacaagaggctgctggggacggtacttaagcctatcagggacgctctgaacg

SEQ ID NO: 22841 - DNA, 60 bp, Artificial Sequence
  Description of Artificial Sequence: Synthetic probe
tgcacaccccgagaacacgcccgacaacaaccccaacaatcccaatccagggacaccact

SEQ ID NO: 22842 - DNA, 60 bp, Artificial Sequence
  Description of Artificial Sequence: Synthetic probe
agttccaactgaaaccaatcgaaaagaaatcaagttcggccatcagatttgtcccggacg

SEQ ID NO: 22843 - DNA, 55 bp, Artificial Sequence
  Description of Artificial Sequence: Synthetic probe
aggacccaggtctacaaatccgcccactccgagacaaccagccccaacgaccgac

SEQ ID NO: 22844 - DNA, 60 bp, Artificial Sequence
  Description of Artificial Sequence: Synthetic probe
cagtggccctaaattaaccggagctctcatcagcatattatcgctgtttgtagagtcacc

SEQ ID NO: 22845 - DNA, 60 bp, Artificial Sequence
  Description of Artificial Sequence: Synthetic probe
caactaatcaagcaattgaggaaatacgacaagcaggccaagaaatgatcctagcagttc

SEQ ID NO: 22846 - DNA, 60 bp, Artificial Sequence
  Description of Artificial Sequence: Synthetic probe
caaccaatcaagcaattgaggaaatacgacaagcaggccaagaaatgatcctggcggttc

SEQ ID NO: 22847 - DNA, 60 bp, Artificial Sequence
  Description of Artificial Sequence: Synthetic probe
tcatttcttggcctgcttgtcgtatttcctcaattgcttgattggttgtttccagacttg

SEQ ID NO: 22848 - DNA, 60 bp, Artificial Sequence
  Description of Artificial Sequence: Synthetic probe
gcggaagcgatctccttgctatactagagagtaaaggtatcaaggctaagataacctatg

SEQ ID NO: 22849 - DNA, 60 bp, Artificial Sequence
  Description of Artificial Sequence: Synthetic probe
gcgggagtgatctccttgtcatactggagagtaaaggtatcaaggctaagataacctatg

SEQ ID NO: 22850 - DNA, 60 bp, Artificial Sequence
  Description of Artificial Sequence: Synthetic probe
caggtactggcgagcaggtcacccatacaggggtagttgggattgagatcaattgcaaca

SEQ ID NO: 22851 - DNA, 60 bp, Artificial Sequence
  Description of Artificial Sequence: Synthetic probe
ggaacctcattgctaactgtgcctctattttgtgcaagtgttacaccactggctcaataa

SEQ ID NO: 22852 - DNA, 60 bp, Artificial Sequence
  Description of Artificial Sequence: Synthetic probe
ggggaacctcattgctaactgtgcctctattttgtgcaagtgttacaccactggctcaat

SEQ ID NO: 22853 - DNA, 60 bp, Artificial Sequence
  Description of Artificial Sequence: Synthetic probe
gggtgtctcctacagtataggatcgcaagagtggtacaccacagtaccgcgatatgtggc

SEQ ID NO: 22854 - DNA, 60 bp, Artificial Sequence
  Description of Artificial Sequence: Synthetic probe
gcgggagtgatctccttgccatactggagagtaaaggtatcaaggctaagataacctatg

SEQ ID NO: 22855 - DNA, 60 bp, Artificial Sequence
  Description of Artificial Sequence: Synthetic probe
tctaccaccggtaggaggcacaaaaggttcgcaggggttgttttggctggtgcagctctc

SEQ ID NO: 22856 - DNA, 60 bp, Artificial Sequence
  Description of Artificial Sequence: Synthetic probe
catccaccatgtcctccccaagagacagggtcaatgctttctacaaggataacctccagt

SEQ ID NO: 22857 - DNA, 60 bp, Artificial Sequence
  Description of Artificial Sequence: Synthetic probe
catggcagaaatttatgattttgacaaatcagcgtgggatgtcaaagggtcgattgcacc

SEQ ID NO: 22858 - DNA, 60 bp, Artificial Sequence
  Description of Artificial Sequence: Synthetic probe
ctccccaacatggcagaaatttatgattttgacaaatcagcgtgggatgtcaaagggtcg

SEQ ID NO: 22859 - DNA, 60 bp, Artificial Sequence
  Description of Artificial Sequence: Synthetic probe
ctcgcactccccaacatggcagaaatttatgattttgacaaatcagcgtgggatgtcaaa

SEQ ID NO: 22860 - DNA, 60 bp, Artificial Sequence
  Description of Artificial Sequence: Synthetic probe
agatcctgacaagatcctaacatatatagctgcagaccaatgccccatcgtagaagtgga

SEQ ID NO: 22861 - DNA, 60 bp, Artificial Sequence
  Description of Artificial Sequence: Synthetic probe
caagatcctgacaagatcctaacatatatagctgcagaccaatgccccatcgtagaagtg

SEQ ID NO: 22862 - DNA, 60 bp, Artificial Sequence
  Description of Artificial Sequence: Synthetic probe
ataagtcaagaccctgacaagatcctaacatatatagctgcagaccaatgccccgtcgta

SEQ ID NO: 22863 - DNA, 56 bp, Artificial Sequence
  Description of Artificial Sequence: Synthetic probe
caagcactgcttggcaacgggattaccgagtctttgaagtaggcataattagagaa

SEQ ID NO: 22864 - DNA, 60 bp, Artificial Sequence
  Description of Artificial Sequence: Synthetic probe
gtcacgggctcggaaaatgataaaggcagggaagactcttgtggtgccgccgatcccctc

SEQ ID NO: 22865 - DNA, 60 bp, Artificial Sequence
  Description of Artificial Sequence: Synthetic probe
agtcacgaattcggaaaatgaccaaggcagggaagactcttgtggtgccgccgatcccct

SEQ ID NO: 22866 - DNA, 60 bp, Artificial Sequence
  Description of Artificial Sequence: Synthetic probe
agtcacgggctcggaaaatgactaaggcagggaagactcttgtggtgccgccgatcccct

SEQ ID NO: 22867 - DNA, 60 bp, Artificial Sequence
  Description of Artificial Sequence: Synthetic probe
atcattgattggtggagggcgatccccgctgtgatctgggctgcggttgcaactccgaga

SEQ ID NO: 22868 - DNA, 60 bp, Artificial Sequence
  Description of Artificial Sequence: Synthetic probe
tctaccactagtaggaggcacaaaaggttcgcaggggttgttttggccggtgcagctctc

SEQ ID NO: 22869 - DNA, 60 bp, Artificial Sequence
  Description of Artificial Sequence: Synthetic probe
aaaccaatccagagttctaccaccggtaggaggcacaaaaggttcgcaggggttgttttg

SEQ ID NO: 22870 - DNA, 60 bp, Artificial Sequence
  Description of Artificial Sequence: Synthetic probe
aaaccgatccagagttctaccactagtaggaggcacaaaaggttcgcaggggttgttttg

SEQ ID NO: 22871 - DNA, 60 bp, Artificial Sequence
  Description of Artificial Sequence: Synthetic probe
ggtcatccaccatgtcttccccaagagacagggtcaatgctttctacaaggataacctcc

SEQ ID NO: 22872 - DNA, 52 bp, Artificial Sequence
  Description of Artificial Sequence: Synthetic probe
ggagaattcaggcttgacaaaggatggcttgacacagtgcgcaacaggatag

SEQ ID NO: 22873 - DNA, 60 bp, Artificial Sequence
  Description of Artificial Sequence: Synthetic probe
gtaattggagaattcaggcttgacaaaggatggcttgacacagtacgtaacaggatagca

SEQ ID NO: 22874 - DNA, 60 bp, Artificial Sequence
  Description of Artificial Sequence: Synthetic probe
ggagagtaattggggaattcaggcttgacaaaggatggcttgacacagtgcgcaacagga

SEQ ID NO: 22875 - DNA, 60 bp, Artificial Sequence
  Description of Artificial Sequence: Synthetic probe
acactcagcaaaggagagtaattggggaattcaggcttgacaaaggatggcttgacacag

SEQ ID NO: 22876 - DNA, 60 bp, Artificial Sequence
  Description of Artificial Sequence: Synthetic probe
ggcccaccaatatcgctagagaagctggatgtggggactgacctcggtaatgcagtgaca

SEQ ID NO: 22877 - DNA, 60 bp, Artificial Sequence
  Description of Artificial Sequence: Synthetic probe
ggcccaccaatatcgctagagaagctggatgtggggactaacctctggaatgcagtgaca

SEQ ID NO: 22878 - DNA, 57 bp, Artificial Sequence
  Description of Artificial Sequence: Synthetic probe
tcaccagtcactagttataaagctgatgcccaatatcactgctatagacaattgcac

SEQ ID NO: 22879 - DNA, 60 bp, Artificial Sequence
  Description of Artificial Sequence: Synthetic probe
gcagaggctctcatcagactgcaggctatggccagcatcctagaggattcaacccttggc

SEQ ID NO: 22880 - DNA, 60 bp, Artificial Sequence
  Description of Artificial Sequence: Synthetic probe
ggaccgtcttgttaaaatggtaggggacccagacatcagtggtccaaaattaaccggggc

SEQ ID NO: 22881 - DNA, 60 bp, Artificial Sequence
  Description of Artificial Sequence: Synthetic probe
ggaccgtcttgttaaaatggtaggggacccagacatcagtggtcctaaattaaccggggc

SEQ ID NO: 22882 - DNA, 60 bp, Artificial Sequence
  Description of Artificial Sequence: Synthetic probe
cttctggaccgtcttgttaaaatggtaggggacccagacatcagtggtccaaaattaacc

SEQ ID NO: 22883 - DNA, 60 bp, Artificial Sequence
  Description of Artificial Sequence: Synthetic probe
cttctggaccgtcttgttaaaatggtaggggacccagacatcagtggtcctaaattaacc

SEQ ID NO: 22884 - DNA, 55 bp, Artificial Sequence
  Description of Artificial Sequence: Synthetic probe
ggggattcctcaatcaccacaagatcacgccttctggaccgtcttgttaaaatgg

SEQ ID NO: 22885 - DNA, 60 bp, Artificial Sequence
  Description of Artificial Sequence: Synthetic probe
gttccgatcccgggagattcctcaatcaccacaagatcacgccttctggaccgtcttgtt

SEQ ID NO: 22886 - DNA, 60 bp, Artificial Sequence
  Description of Artificial Sequence: Synthetic probe
cgttgttccgatcccgggagattcctcaatcaccacaagatcacgccttctggaccgtct

SEQ ID NO: 22887 - DNA, 60 bp, Artificial Sequence
  Description of Artificial Sequence: Synthetic probe
tcatcgttgttccgattccgggggattcctcaatcaccacaagatcacgccttctggacc

SEQ ID NO: 22888 - DNA, 60 bp, Artificial Sequence
  Description of Artificial Sequence: Synthetic probe
tcatcgttgttccgatcccgggagattcctcaatcaccacaagatcacgccttctggacc

SEQ ID NO: 22889 - DNA, 60 bp, Artificial Sequence
  Description of Artificial Sequence: Synthetic probe
acaatatagggtcacaagagtggtacaccacagtaccgcgatatgtggcaacccagggtt

SEQ ID NO: 22890 - DNA, 60 bp, Artificial Sequence
  Description of Artificial Sequence: Synthetic probe
tacaatatagggtcacaggagtggtacaccacagtaccgcgatatgtggcaacccagggt

SEQ ID NO: 22891 - DNA, 60 bp, Artificial Sequence
  Description of Artificial Sequence: Synthetic probe
ggttatagtgcactaattcggaaatgattctgcaattgcctgcctcctgatctcgatcta

SEQ ID NO: 22892 - DNA, 60 bp, Artificial Sequence
  Description of Artificial Sequence: Synthetic probe
gtgtgcacatgcttagaggcgactaactcaagacttggattgggttctgatttgggtgtc

SEQ ID NO: 22893 - DNA, 60 bp, Artificial Sequence
  Description of Artificial Sequence: Synthetic probe
ggtgactgttacacccctacctacctatcagaccgggctgatgatgatgttaagctaagc

SEQ ID NO: 22894 - DNA, 60 bp, Artificial Sequence
  Description of Artificial Sequence: Synthetic probe
atcagacaagattaagttccttaaccctgataaagagtacgattttagggatatcaactg

SEQ ID NO: 22895 - DNA, 60 bp, Artificial Sequence
  Description of Artificial Sequence: Synthetic probe
ccgcctagaaggtgtctcttacaacatagggtcacaagagtggtacaccacggtaccgcg

SEQ ID NO: 22896 - DNA, 60 bp, Artificial Sequence
  Description of Artificial Sequence: Synthetic probe
tccgctgtggaccctcccagctgggcggccccggactcccgaacccacatgggcatcaaa

SEQ ID NO: 22897 - DNA, 60 bp, Artificial Sequence
  Description of Artificial Sequence: Synthetic probe
aaccaaagcccaaacaacacgcggtcgccacacacccagaggacacgcccgacaacaacc

SEQ ID NO: 22898 - DNA, 60 bp, Artificial Sequence
  Description of Artificial Sequence: Synthetic probe
ccagcggcaggtcagataggcacaaggaagatcccaataaagaacccgtaagccctccag

SEQ ID NO: 22899 - DNA, 60 bp, Artificial Sequence
  Description of Artificial Sequence: Synthetic probe
aaaagcttgggtatagcgggagtgatctccttgctatactggaaagtaagggtatcaagg

SEQ ID NO: 22900 - DNA, 60 bp, Artificial Sequence
  Description of Artificial Sequence: Synthetic probe
gggctgacgatgatgttaaattgagctccaatcttgtaatcctcccaagtagggacctcc

SEQ ID NO: 22901 - DNA, 60 bp, Artificial Sequence
  Description of Artificial Sequence: Synthetic probe
ccggtctgacgatgatgttaaattgagctccaatcttgtaatcctcccgagtaggaacct

SEQ ID NO: 22902 - DNA, 60 bp, Artificial Sequence
  Description of Artificial Sequence: Synthetic probe
accggtctgacgatgatgttaaattgagctccaatcttgtaatcctcccgagtaggaacc

SEQ ID NO: 22903 - DNA, 60 bp, Artificial Sequence
  Description of Artificial Sequence: Synthetic probe
caaccaatcaagcagttgaggaaatacgacaagcaggccaagaaatgattctagcggttc

SEQ ID NO: 22904 - DNA, 60 bp, Artificial Sequence
  Description of Artificial Sequence: Synthetic probe
gtggcattgatcttagatatcaagagaaccccaggcaataaaccaaggatcgctgaaatg

SEQ ID NO: 22905 - DNA, 60 bp, Artificial Sequence
  Description of Artificial Sequence: Synthetic probe
cacatcgaggccgaggcaaaactatccctcgctggcccttcatggaacataggccccatt

SEQ ID NO: 22906 - DNA, 60 bp, Artificial Sequence
  Description of Artificial Sequence: Synthetic probe
ccggtcacccgaacaacgaggctgcaacaccggtggccccgatcagatagagagttatga

SEQ ID NO: 22907 - DNA, 60 bp, Artificial Sequence
  Description of Artificial Sequence: Synthetic probe
caaagagccaggaggccaagcatagtatggcaacaggattaccgagtcttcgaagtaggc

SEQ ID NO: 22908 - DNA, 52 bp, Artificial Sequence
  Description of Artificial Sequence: Synthetic probe
cgggactccacctccacaccacgccagatgggaacagagggccccactcccc

SEQ ID NO: 22909 - DNA, 60 bp, Artificial Sequence
  Description of Artificial Sequence: Synthetic probe
gcggttattacactgtaccaaggaagatactagagttcagatccgccaatgcagtggcct

SEQ ID NO: 22910 - DNA, 60 bp, Artificial Sequence
  Description of Artificial Sequence: Synthetic probe
ccccaagtgagagtaattgatccaggactcggggatcggaaagacgagtgctttatgtat

SEQ ID NO: 22911 - DNA, 60 bp, Artificial Sequence
  Description of Artificial Sequence: Synthetic probe
ggggactcaacccttggcaatgacagtctgagagcatacaacgacaaggatcttctcaac

SEQ ID NO: 22912 - DNA, 60 bp, Artificial Sequence
  Description of Artificial Sequence: Synthetic probe
gaggttcaggatccggaagggttcaatatgatactggcaaccatcttagcccagatctgg

SEQ ID NO: 22913 - DNA, 52 bp, Artificial Sequence
  Description of Artificial Sequence: Synthetic probe
tcactgatgaccctgatatcagcattaaattggtggaggtaatccaaagtga

SEQ ID NO: 22914 - DNA, 60 bp, Artificial Sequence
  Description of Artificial Sequence: Synthetic probe
gagagctggcaccgtacccgtctgaggtaagcctggtcgaacatcagcttggtgtggaga

SEQ ID NO: 22915 - DNA, 60 bp, Artificial Sequence
  Description of Artificial Sequence: Synthetic probe
taaccccaatttcaacatccaccaacctcgcacataggcttagggatcggagtacccagg

SEQ ID NO: 22916 - DNA, 60 bp, Artificial Sequence
  Description of Artificial Sequence: Synthetic probe
catgggaggggatcggcggcacccaaagggtctttcccgccttagtcattttccgagccc

SEQ ID NO: 22917 - DNA, 60 bp, Artificial Sequence
  Description of Artificial Sequence: Synthetic probe
agtcacgggctcggaaaatgactaaggcgggaaagacccttgtggtgccgccgatcccct

SEQ ID NO: 22918 - DNA, 58 bp, Artificial Sequence
  Description of Artificial Sequence: Synthetic probe
cccatccctccaacaacaagagcttccgatgttgagacagtagaaggggacgaaatcc

SEQ ID NO: 22919 - DNA, 60 bp, Artificial Sequence
  Description of Artificial Sequence: Synthetic probe
taagtggagactatgtccagggattcatgagttatatggtgccttattacagagaggtac

SEQ ID NO: 22920 - DNA, 60 bp, Artificial Sequence
  Description of Artificial Sequence: Synthetic probe
ggagacacttcatcaggtgatgacacaacaacctggtgactcatcatttctcgactgggc

SEQ ID NO: 22921 - DNA, 60 bp, Artificial Sequence
  Description of Artificial Sequence: Synthetic probe
ccggtcacccgaacaacgaggctgcaacacaggtggccccgatcagatagagagttatga

SEQ ID NO: 22922 - DNA, 60 bp, Artificial Sequence
  Description of Artificial Sequence: Synthetic probe
gcaatgggaaatagtggtgtctagactcagcagaggcttataaaccagggcctcccacaa

SEQ ID NO: 22923 - DNA, 60 bp, Artificial Sequence
  Description of Artificial Sequence: Synthetic probe
caaagagccaggaggccaagcaaagtatggcaccaggattaccgagtcttcgaagtaggc

SEQ ID NO: 22924 - DNA, 60 bp, Artificial Sequence
  Description of Artificial Sequence: Synthetic probe
gcggttattacactgtaccaaggaagatgctagagttcagatccgccaatgcagtggcct

SEQ ID NO: 22925 - DNA, 60 bp, Artificial Sequence
  Description of Artificial Sequence: Synthetic probe
caactgagtgagtgccccgcacgctccagcacgcaatctccccatgcaaagcgccattat

SEQ ID NO: 22926 - DNA, 60 bp, Artificial Sequence
  Description of Artificial Sequence: Synthetic probe
gtggcattgatcttagatatcaagagaactccaggcaataaaccaaggatcgctgaaatg

SEQ ID NO: 22927 - DNA, 60 bp, Artificial Sequence
  Description of Artificial Sequence: Synthetic probe
cggtggacccagggccaagactttctcctccaagaagacacacactggggctggtatctc

SEQ ID NO: 22928 - DNA, 60 bp, Artificial Sequence
  Description of Artificial Sequence: Synthetic probe
cccgcggcagatctccccagccgggcagcccaaggccaccaaatccatccgagcatcaaa

SEQ ID NO: 22929 - DNA, 60 bp, Artificial Sequence
  Description of Artificial Sequence: Synthetic probe
aggatccagaagggttcaatatgatactggcaaccatcttagcccagatctggatcttat

SEQ ID NO: 22930 - DNA, 60 bp, Artificial Sequence
  Description of Artificial Sequence: Synthetic probe
ccaggacccagaagggttcaatatgatactggcaaccatcttagcccagatctggatctt

SEQ ID NO: 22931 - DNA, 60 bp, Artificial Sequence
  Description of Artificial Sequence: Synthetic probe
gaggtccaggatccagaagggttcaatatgatactggcaaccatcttagcccagatctgg

SEQ ID NO: 22932 - DNA, 60 bp, Artificial Sequence
  Description of Artificial Sequence: Synthetic probe
gaagtccaagacccagaagggttcaatatgatactggcaaccatcttagcccagatctgg

SEQ ID NO: 22933 - DNA, 60 bp, Artificial Sequence
  Description of Artificial Sequence: Synthetic probe
tgcagctctcggagttgcaaccgcagcccagatcacagcagggatcgcccttcatcagtc

SEQ ID NO: 22934 - DNA, 60 bp, Artificial Sequence
  Description of Artificial Sequence: Synthetic probe
tgcagctctcggagttgcaaccgcagcccagattacagcggggattgcccttcatcagtc

SEQ ID NO: 22935 - DNA, 60 bp, Artificial Sequence
  Description of Artificial Sequence: Synthetic probe
ggttgttttggccggtgcagctctcggagttgcaaccgcagcccagattacagcggggat

SEQ ID NO: 22936 - DNA, 60 bp, Artificial Sequence
  Description of Artificial Sequence: Synthetic probe
ttcgcaggggttgttttggccggtgcagctctcggagttgcaaccgcagcccagattaca

SEQ ID NO: 22937 - DNA, 60 bp, Artificial Sequence
  Description of Artificial Sequence: Synthetic probe
ctcagacaccctggccactctttcagcagtagatccgaccttggatgggctctatatcac

SEQ ID NO: 22938 - DNA, 60 bp, Artificial Sequence
  Description of Artificial Sequence: Synthetic probe
cgcagcatatacaggtgatgatcggagcaatagaacctccggacccaaacaggcccaggt

SEQ ID NO: 22939 - DNA, 60 bp, Artificial Sequence
  Description of Artificial Sequence: Synthetic probe
cgcagcatatacaggtgatgaccggagcaatagaacctccggacccaaacaggcccaggt

SEQ ID NO: 22940 - DNA, 60 bp, Artificial Sequence
  Description of Artificial Sequence: Synthetic probe
cgcagcatatacaggcgatgatcggaacaatagaacctccggacccaaacaggcccaggt

SEQ ID NO: 22941 - DNA, 60 bp, Artificial Sequence
  Description of Artificial Sequence: Synthetic probe
cctggcgttggctctgctgttaggtaaagtaggttcagtattggtgatcaaagtaatgcc

SEQ ID NO: 22942 - DNA, 60 bp, Artificial Sequence
  Description of Artificial Sequence: Synthetic probe
agtcgttccttgcggtccgcagtgcggatagccacagtgtactcatgggcatacggggat

SEQ ID NO: 22943 - DNA, 60 bp, Artificial Sequence
  Description of Artificial Sequence: Synthetic probe
ggaagtcatttgctggtgtgaggttcggctgcttcatgcccctgagtttagacagtgacc

SEQ ID NO: 22944 - DNA, 60 bp, Artificial Sequence
  Description of Artificial Sequence: Synthetic probe
tgacccggcaaaagctcataacccagggccacccacggtgacgagactaagcaccgcaaa

SEQ ID NO: 22945 - DNA, 60 bp, Artificial Sequence
  Description of Artificial Sequence: Synthetic probe
cagaggtccagaaagtcaagcacaggacggcaacaggattaccgagtctttgaagtaggc

SEQ ID NO: 22946 - DNA, 60 bp, Artificial Sequence
  Description of Artificial Sequence: Synthetic probe
ccccacgtgatcaccaccctcgaacaccccagcaaaccccacgatgctctgccctcccca

SEQ ID NO: 22947 - DNA, 60 bp, Artificial Sequence
  Description of Artificial Sequence: Synthetic probe
caggtccccaaatccacccgtgcactaaaccacggcagagcagtcaagacacagcccaac

SEQ ID NO: 22948 - DNA, 60 bp, Artificial Sequence
  Description of Artificial Sequence: Synthetic probe
ccccggcaccacccacctccgcaatcaatcaaaatccaaacaacacgcgagtgccacaca

SEQ ID NO: 22949 - DNA, 60 bp, Artificial Sequence
  Description of Artificial Sequence: Synthetic probe
ctccgagtcaaccaaccccagcgatcgacccagatggcagaagagcaagcctaccatgtc

SEQ ID NO: 22950 - DNA, 60 bp, Artificial Sequence
  Description of Artificial Sequence: Synthetic probe
gttccgatccctggagactcctcaatcaccacaagatcacgtcttctagatcgtctcgtc

SEQ ID NO: 22951 - DNA, 60 bp, Artificial Sequence
  Description of Artificial Sequence: Synthetic probe
ttcagccctagcttctgacccacgatatcacacgataattggcccatcgcaggcaccagc

SEQ ID NO: 22952 - DNA, 60 bp, Artificial Sequence
  Description of Artificial Sequence: Synthetic probe
cagccctagcttctgacccacgatatcacacgataattggcccatcgcaggcaccagctc

SEQ ID NO: 22953 - DNA, 60 bp, Artificial Sequence
  Description of Artificial Sequence: Synthetic probe
ccaccacctttctgtaacagtacagattgggagccactagaggctggccgaataccggcg

SEQ ID NO: 22954 - DNA, 51 bp, Artificial Sequence
  Description of Artificial Sequence: Synthetic probe
cgagctgctgtcaacacagcagagatcaacagtggcctgacaacaagcatc

SEQ ID NO: 22955 - DNA, 60 bp, Artificial Sequence
  Description of Artificial Sequence: Synthetic probe
gactccaccgagctgctgtcaacacagcagagatcaacagtggcctgacgacaagcattg

SEQ ID NO: 22956 - DNA, 60 bp, Artificial Sequence
  Description of Artificial Sequence: Synthetic probe
gactccaccgagctgctgtcaacacagcagagatcaacagtggtctgacgacaagcattg

SEQ ID NO: 22957 - DNA, 60 bp, Artificial Sequence
  Description of Artificial Sequence: Synthetic probe
atcagactccaccgagctgctgtcaacacagcagagatcaacagtggcctgacgacaagc

SEQ ID NO: 22958 - DNA, 60 bp, Artificial Sequence
  Description of Artificial Sequence: Synthetic probe
atcagactccaccgagctgctgtcaacacagcagagatcaacagtggtctgacgacaagc

SEQ ID NO: 22959 - DNA, 60 bp, Artificial Sequence
  Description of Artificial Sequence: Synthetic probe
agctggtgcctgcgatgggccaattatcgtgtgatatggtgggtcaaaagctaggactga

SEQ ID NO: 22960 - DNA, 60 bp, Artificial Sequence
  Description of Artificial Sequence: Synthetic probe
aatgagctggtgcctgcgatgggccaattatcgtgtgatatggtgggtcaaaagctaggg

SEQ ID NO: 22961 - DNA, 60 bp, Artificial Sequence
  Description of Artificial Sequence: Synthetic probe
cctggcggttcaaggtgttcaagattatatcaacaatgagctggtgcctgcgatgggcca

SEQ ID NO: 22962 - DNA, 60 bp, Artificial Sequence
  Description of Artificial Sequence: Synthetic probe
aggcaccagctcattgttgatataatcttgaacaccttgaaccgccaggatcatttcttg

SEQ ID NO: 22963 - DNA, 60 bp, Artificial Sequence
  Description of Artificial Sequence: Synthetic probe
caggccaagaaatgatcctggcggttcaaggtgttcaagattatatcaacaatgagctgg

SEQ ID NO: 22964 - DNA, 60 bp, Artificial Sequence
  Description of Artificial Sequence: Synthetic probe
cagctcattgttgatataatcttgaacaccttgaaccgccaggatcatttcttggcctgc

SEQ ID NO: 22965 - DNA, 60 bp, Artificial Sequence
  Description of Artificial Sequence: Synthetic probe
gtcatttgccggtgtaaggttcggctgcttcatgcccttgagtttagacagtgacctcac

SEQ ID NO: 22966 - DNA, 60 bp, Artificial Sequence
  Description of Artificial Sequence: Synthetic probe
gttctggttcacgatcaagacagaaatgagatcaacaatcaaatcttcagcacataccag

SEQ ID NO: 22967 - DNA, 60 bp, Artificial Sequence
  Description of Artificial Sequence: Synthetic probe
gcagaccaatgccctgtcgtagaagtagacggtgttaccatccaggtcgggagcagagag

SEQ ID NO: 22968 - DNA, 60 bp, Artificial Sequence
  Description of Artificial Sequence: Synthetic probe
ccgcctagaaggtgtctcttacaacataggatcacaagagtggtacaccacggtaccgcg

SEQ ID NO: 22969 - DNA, 60 bp, Artificial Sequence
  Description of Artificial Sequence: Synthetic probe
tccgctgtggaccctcccagctgggcagccccggactcccaaacccacatgggcatcaaa

SEQ ID NO: 22970 - DNA, 55 bp, Artificial Sequence
  Description of Artificial Sequence: Synthetic probe
ggactccaccccagcatcacgccccacaagaacagtgagccccaatctcccacct

SEQ ID NO: 22971 - DNA, 60 bp, Artificial Sequence
  Description of Artificial Sequence: Synthetic probe
gaagaccagtcgcgggctaggaaaatgaccaaagcagggaagatacttgtggtgccgcag

SEQ ID NO: 22972 - DNA, 60 bp, Artificial Sequence
  Description of Artificial Sequence: Synthetic probe
gatcctctagggagcaagaagtcggcagaggctctcatcagactgcaggctatggccagc

SEQ ID NO: 22973 - DNA, 60 bp, Artificial Sequence
  Description of Artificial Sequence: Synthetic probe
ccagcggcaggtcagataggtacaaggaagatccaaataaagaacccgtaagccctccag

SEQ ID NO: 22974 - DNA, 60 bp, Artificial Sequence
  Description of Artificial Sequence: Synthetic probe
cgcaggtttatggtggcattgatcttagatatcaagagaaccccaggtaataaaccgagg

SEQ ID NO: 22975 - DNA, 60 bp, Artificial Sequence
  Description of Artificial Sequence: Synthetic probe
ctcggcacaacacggctgatccttgcgcttctcctcagcttagcagtagcctgcatgctc

SEQ ID NO: 22976 - DNA, 60 bp, Artificial Sequence
  Description of Artificial Sequence: Synthetic probe
tcaagtttgtcccggacgacagtgtcgcatctcgcagtgtgatccgctcaatcatcaagt

SEQ ID NO: 22977 - DNA, 60 bp, Artificial Sequence
  Description of Artificial Sequence: Synthetic probe
cctgagacccataattggtcgggactctgggagggcgcttgctgaggtgcttaagaagcc

SEQ ID NO: 22978 - DNA, 60 bp, Artificial Sequence
  Description of Artificial Sequence: Synthetic probe
tgcggggaatgccctcgtgtctgtgagcaatgctccaccgattcagggatcgaaaacagg

SEQ ID NO: 22979 - DNA, 60 bp, Artificial Sequence
  Description of Artificial Sequence: Synthetic probe
ccgatcccctctcatgagaagccaactgcatcagagcaacccactaaaaagggcacagac

SEQ ID NO: 22980 - DNA, 60 bp, Artificial Sequence
  Description of Artificial Sequence: Synthetic probe
gatggggagctgggagcactcatggatgacctcccagtgcacaataccgaggtacagtgt

SEQ ID NO: 22981 - DNA, 58 bp, Artificial Sequence
  Description of Artificial Sequence: Synthetic probe
cttaggacccaagcctacgagtccgcccaccccgagacaacccgccccagcagccgac

SEQ ID NO: 22982 - DNA, 60 bp, Artificial Sequence
  Description of Artificial Sequence: Synthetic probe
ccgagcccgtgactgatcttccaatagcttttggatttcgtccccttctactgtctcaac

SEQ ID NO: 22983 - DNA, 60 bp, Artificial Sequence
  Description of Artificial Sequence: Synthetic probe
ttccgagcccgtgactgatcttccaatagcttttggatttcgtccccttctactgtctca

SEQ ID NO: 22984 - DNA, 58 bp, Artificial Sequence
  Description of Artificial Sequence: Synthetic probe
ttttaatgggtttctctgatgcaacagacctctcatgggaggggatcggcggcaccca

SEQ ID NO: 22985 - DNA, 60 bp, Artificial Sequence
  Description of Artificial Sequence: Synthetic probe
aacgacaaggatctcctcagctaaatgaatgctccacacgcctcagcccgcgatctcccc

SEQ ID NO: 22986 - DNA, 60 bp, Artificial Sequence
  Description of Artificial Sequence: Synthetic probe
ggtgatgaccggaacagtaggacctccggacccaaacagacccaggtttcatttctgcgt

SEQ ID NO: 22987 - DNA, 60 bp, Artificial Sequence
  Description of Artificial Sequence: Synthetic probe
caggcttgacaaaggatggcttgacacagtacgtaacaggatagcagaagatctctcctt

SEQ ID NO: 22988 - DNA, 60 bp, Artificial Sequence
  Description of Artificial Sequence: Synthetic probe
ccccttgctgcaggctctggtggtgctattcggggaatcaagcatgtcattattgtcccg

SEQ ID NO: 22989 - DNA, 60 bp, Artificial Sequence
  Description of Artificial Sequence: Synthetic probe
gaatagagagattcaagacattgaagtccaggatccagaagggttcaatatgatactggc

SEQ ID NO: 22990 - DNA, 60 bp, Artificial Sequence
  Description of Artificial Sequence: Synthetic probe
ggcatagaaactatgtacccagcactgggcctgcatgaatttgccggagaactctccaca

SEQ ID NO: 22991 - DNA, 60 bp, Artificial Sequence
  Description of Artificial Sequence: Synthetic probe
atctgagaacagcgatgtggatcctggcgaacctgatcccgagggaagtgctcccgctga

SEQ ID NO: 22992 - DNA, 60 bp, Artificial Sequence
  Description of Artificial Sequence: Synthetic probe
accactggctcaataataagtcaagaccctgacaagatcctaacatatatagctgcagac

SEQ ID NO: 22993 - DNA, 60 bp, Artificial Sequence
  Description of Artificial Sequence: Synthetic probe
ctgtgatggggagctgggagcactcatggatgacctcccagtgcacaataccgaggtaca

SEQ ID NO: 22994 - DNA, 60 bp, Artificial Sequence
  Description of Artificial Sequence: Synthetic probe
gctgcggttgcaactccgagagctgcaccagccaaaacaacccctgcgaacctcttgtgc

SEQ ID NO: 22995 - DNA, 60 bp, Artificial Sequence
  Description of Artificial Sequence: Synthetic probe
ctgaagaacatcaagggtgtttcagtcactaacacaggttatattttaatcggagtcggg

SEQ ID NO: 22996 - DNA, 60 bp, Artificial Sequence
  Description of Artificial Sequence: Synthetic probe
gaaatgatcctagcggtccaaggtgtccaagattacattaacaatgaactggtgcctgcg

SEQ ID NO: 22997 - DNA, 60 bp, Artificial Sequence
  Description of Artificial Sequence: Synthetic probe
acaagatcctaacatatatagctgcagaccaatgccccatcgtagaagtgaacggtgtaa

SEQ ID NO: 22998 - DNA, 60 bp, Artificial Sequence
  Description of Artificial Sequence: Synthetic probe
ggacccagcctcagagacccggtttcggctgagatttctattcaggccttgagttatgcc

SEQ ID NO: 22999 - DNA, 60 bp, Artificial Sequence
  Description of Artificial Sequence: Synthetic probe
ttagccagttttatactcactatcaaatttggtatagaaactatgtacccagcactgggc

SEQ ID NO: 23000 - DNA, 60 bp, Artificial Sequence
  Description of Artificial Sequence: Synthetic probe
gtgttacaccactggctcaataataagtcaagatcctgacaagatcctgacctatatagc

SEQ ID NO: 23001 - DNA, 60 bp, Artificial Sequence
  Description of Artificial Sequence: Synthetic probe
ttcggcagatcttattttgaccctgcatatttcaggctaggacaagaaatggtacggagg

SEQ ID NO: 23002 - DNA, 60 bp, Artificial Sequence
  Description of Artificial Sequence: Synthetic probe
gttgtggagctatgctatgggagttggggttgaactagagaactctatgggaggacttaa

SEQ ID NO: 23003 - DNA, 60 bp, Artificial Sequence
  Description of Artificial Sequence: Synthetic probe
tttcacgtctgtgccctttttaatgggtttctctgatgcaacagacctctcatgggaggg

SEQ ID NO: 23004 - DNA, 51 bp, Artificial Sequence
  Description of Artificial Sequence: Synthetic probe
ctaggagtgggcacaccagtgtttcatatgacaaactatctggaactccca

SEQ ID NO: 23005 - DNA, 60 bp, Artificial Sequence
  Description of Artificial Sequence: Synthetic probe
attagagaactaggagtgggcacaccagtgtttcatatgacaaactatctggaactccca

SEQ ID NO: 23006 - DNA, 60 bp, Artificial Sequence
  Description of Artificial Sequence: Synthetic probe
aggtatcagactccatcgagctgctgtcaacacagcagagatcaacagtggcctgacaac

SEQ ID NO: 23007 - DNA, 60 bp, Artificial Sequence
  Description of Artificial Sequence: Synthetic probe
ctgggagtatgggcatcaccagccgacttagacaccctggccactctttcagcagtagat

SEQ ID NO: 23008 - DNA, 60 bp, Artificial Sequence
  Description of Artificial Sequence: Synthetic probe
ggagtgggcacaccagtgtttcatatgacaaactacctggagctcccaagacagccggaa

SEQ ID NO: 23009 - DNA, 60 bp, Artificial Sequence
  Description of Artificial Sequence: Synthetic probe
ccgagagctgcaccagccaaaacaacccctgcgaacctcttgtgcctcctactggtggta

SEQ ID NO: 23010 - DNA, 60 bp, Artificial Sequence
  Description of Artificial Sequence: Synthetic probe
cagggatatcaactggtgtatcaaccctccagagagaatcaagattaattatgatcagta

SEQ ID NO: 23011 - DNA, 60 bp, Artificial Sequence
  Description of Artificial Sequence: Synthetic probe
cgggatcaaattcgccaggatccacatcgctgttctcagattcctcatctcctccccaga

SEQ ID NO: 23012 - DNA, 60 bp, Artificial Sequence
  Description of Artificial Sequence: Synthetic probe
aaggcagtcttattggtttgagaaccgggagatccaggacattgaagttcaggatccaga

SEQ ID NO: 23013 - DNA, 60 bp, Artificial Sequence
  Description of Artificial Sequence: Synthetic probe
ctcccctcttcaaaataattggagatgaggtcgggttgaggacacctcagagattcacag

SEQ ID NO: 23014 - DNA, 60 bp, Artificial Sequence
  Description of Artificial Sequence: Synthetic probe
tcttaactcccctcttcaaaataattggagatgaggtcgggttgaggacacctcagagat

SEQ ID NO: 23015 - DNA, 60 bp, Artificial Sequence
  Description of Artificial Sequence: Synthetic probe
ggtcttaaggcaagtctggaaacaaccaatcaagcaattgaggaaatacgacaagcaggc

SEQ ID NO: 23016 - DNA, 60 bp, Artificial Sequence
  Description of Artificial Sequence: Synthetic probe
aaatgaccaaggcagggaagactcttgtggtgccgccgatcccctctcaggagaggccaa

SEQ ID NO: 23017 - DNA, 60 bp, Artificial Sequence
  Description of Artificial Sequence: Synthetic probe
gaaaatgaccaaggcagggaagactcttgtggtgccgccgatcccctctcatgagaagcc

SEQ ID NO: 23018 - DNA, 60 bp, Artificial Sequence
  Description of Artificial Sequence: Synthetic probe
aggaatctgagaacagcgatgtggattctggcgaacctgatcccgagggaagtgctcccg

SEQ ID NO: 23019 - DNA, 60 bp, Artificial Sequence
  Description of Artificial Sequence: Synthetic probe
ccaggtcatgcgctcgtacactggtctctgggtccatagggaataggtttatcctatcta

SEQ ID NO: 23020 - DNA, 60 bp, Artificial Sequence
  Description of Artificial Sequence: Synthetic probe
ggttgttttggctggtgcagctctcggagttgcaaccgcagctcagattacagcggggat

SEQ ID NO: 23021 - DNA, 60 bp, Artificial Sequence
  Description of Artificial Sequence: Synthetic probe
cctgggaattcatcattgattggtggagggcgatccccgctgtgatctgggctgcggttg

SEQ ID NO: 23022 - DNA, 60 bp, Artificial Sequence
  Description of Artificial Sequence: Synthetic probe
cactggccagatccactggggcaatctttcgaagattggggttgtagggacgggtagtgc

SEQ ID NO: 23023 - DNA, 60 bp, Artificial Sequence
  Description of Artificial Sequence: Synthetic probe
agtcactggccagatccactggggcaatctttcgaaaattggggttgtagggacgggtag

SEQ ID NO: 23024 - DNA, 60 bp, Artificial Sequence
  Description of Artificial Sequence: Synthetic probe
acctcattgccaactgtgcctcaatcttgtgcaagtgttacaccactggctcaataataa

SEQ ID NO: 23025 - DNA, 60 bp, Artificial Sequence
  Description of Artificial Sequence: Synthetic probe
cttatctaaggggaacctcattgctaactgtgcctctattttgtgcaagtgttacaccac

SEQ ID NO: 23026 - DNA, 60 bp, Artificial Sequence
  Description of Artificial Sequence: Synthetic probe
atcctatctaaggggaacctcattgctaactgtgcctctattttgtgcaagtgttacacc

SEQ ID NO: 23027 - DNA, 60 bp, Artificial Sequence
  Description of Artificial Sequence: Synthetic probe
gggaataggtttatcttatctaaggggaacctcattgctaactgtgcctctattttgtgc

SEQ ID NO: 23028 - DNA, 60 bp, Artificial Sequence
  Description of Artificial Sequence: Synthetic probe
ataattagagaactaggagtgggcacaccagtgtttcatatgacaaactacctggagctc

SEQ ID NO: 23029 - DNA, 60 bp, Artificial Sequence
  Description of Artificial Sequence: Synthetic probe
caggattaccgagtctttgaagtaggcataattagagaactaggagtgggcacaccagtg

SEQ ID NO: 23030 - DNA, 60 bp, Artificial Sequence
  Description of Artificial Sequence: Synthetic probe
gcttggcaacaggattaccgagtctttgaagtaggcataattagagaactaggagtgggc

SEQ ID NO: 23031 - DNA, 60 bp, Artificial Sequence
  Description of Artificial Sequence: Synthetic probe
ggacggcaacaggattaccgagtctttgaagtaggcataattagagaactaggagtgggc

SEQ ID NO: 23032 - DNA, 60 bp, Artificial Sequence
  Description of Artificial Sequence: Synthetic probe
caggttggcaacaggattaccgagtctttgaagtaggcataattagagaactaggagtgg

SEQ ID NO: 23033 - DNA, 60 bp, Artificial Sequence
  Description of Artificial Sequence: Synthetic probe
agactccatcgagctgctgtcaacacagcagagatcaacagtggcctgacaacaagcatc

SEQ ID NO: 23034 - DNA, 58 bp, Artificial Sequence
  Description of Artificial Sequence: Synthetic probe
ttttgtgcaagtgttacaccactggctcaataataagtcaggatcctgataagatcct

SEQ ID NO: 23035 - DNA, 60 bp, Artificial Sequence
  Description of Artificial Sequence: Synthetic probe
ccagaagggttcaatatgatactggcaaccatcttagcccagatctggatcttattggcc

SEQ ID NO: 23036 - DNA, 60 bp, Artificial Sequence
  Description of Artificial Sequence: Synthetic probe
gggaggagatgaggaatctgagaacagcgatgtggatcctggcgaacttgatcccgaagg

SEQ ID NO: 23037 - DNA, 60 bp, Artificial Sequence
  Description of Artificial Sequence: Synthetic probe
cactatcaaatttggcatagaaactatgtacccagcactgggcctgcatgaatttgccgg

SEQ ID NO: 23038 - DNA, 60 bp, Artificial Sequence
  Description of Artificial Sequence: Synthetic probe
tagggtcgcaagagtggtacaccacagtaccgcgatatgtggcaacccaaggttacctca

SEQ ID NO: 23039 - DNA, 60 bp, Artificial Sequence
  Description of Artificial Sequence: Synthetic probe
tctaccatagaaggccatctttctagtatcatgatcgcgatcccgggatttggcaaggat

SEQ ID NO: 23040 - DNA, 60 bp, Artificial Sequence
  Description of Artificial Sequence: Synthetic probe
caaccaatcaagcaattgaggaaatacgacaagcaggccaggagatgatcctggcggttc

SEQ ID NO: 23041 - DNA, 60 bp, Artificial Sequence
  Description of Artificial Sequence: Synthetic probe
catttcttggcctgcttgtcgtatttcctcaattgcttgattggttgtttccagacttgc

SEQ ID NO: 23042 - DNA, 60 bp, Artificial Sequence
  Description of Artificial Sequence: Synthetic probe
gcaagtctggaaacaaccaatcaagcaattgaggaaatacgacaagcaggccaggaaatg

SEQ ID NO: 23043 - DNA, 60 bp, Artificial Sequence
  Description of Artificial Sequence: Synthetic probe
taaggcaagtctggaaacaaccaatcaagcaattgaggaaatacgacaagcaggccaaga

SEQ ID NO: 23044 - DNA, 60 bp, Artificial Sequence
  Description of Artificial Sequence: Synthetic probe
gccaaggatctactagattcatctgatctgatcctggaaaccatcaagggtgcttcagtc

SEQ ID NO: 23045 - DNA, 60 bp, Artificial Sequence
  Description of Artificial Sequence: Synthetic probe
ggagaaagccaaggatctactagattcatctgatctgatcctggaaaacatcaagggtgt

SEQ ID NO: 23046 - DNA, 60 bp, Artificial Sequence
  Description of Artificial Sequence: Synthetic probe
gccgctctcggggttgcaaccgcagcccagattacagcagggattgctcttcatcagtca

SEQ ID NO: 23047 - DNA, 60 bp, Artificial Sequence; identical to SEQ ID NO: 13218
  Description of Artificial Sequence: Synthetic probe

SEQ ID NO: 23048 - DNA, 60 bp, Artificial Sequence; identical to SEQ ID NO: 13219
  Description of Artificial Sequence: Synthetic probe

SEQ ID NO: 23049 - DNA, 60 bp, Artificial Sequence; identical to SEQ ID NO: 13220
  Description of Artificial Sequence: Synthetic probe

SEQ ID NO: 23050 - DNA, 60 bp, Artificial Sequence; identical to SEQ ID NO: 13221
  Description of Artificial Sequence: Synthetic probe

SEQ ID NO: 23051 - DNA, 56 bp, Artificial Sequence; identical to SEQ ID NO: 13222
  Description of Artificial Sequence: Synthetic probe

SEQ ID NO: 23052 - DNA, 60 bp, Artificial Sequence; identical to SEQ ID NO: 13223
  Description of Artificial Sequence: Synthetic probe

SEQ ID NO: 23053 - DNA, 60 bp, Artificial Sequence; identical to SEQ ID NO: 13224
  Description of Artificial Sequence: Synthetic probe

SEQ ID NO: 23054 - DNA, 60 bp, Artificial Sequence; identical to SEQ ID NO: 13225
  Description of Artificial Sequence: Synthetic probe

SEQ ID NO: 23055 - DNA, 52 bp, Artificial Sequence; identical to SEQ ID NO: 13241
  Description of Artificial Sequence: Synthetic probe

SEQ ID NO: 23056 - DNA, 60 bp, Artificial Sequence; identical to SEQ ID NO: 13242
  Description of Artificial Sequence: Synthetic probe

SEQ ID NO: 23057 - DNA, 60 bp, Artificial Sequence; identical to SEQ ID NO: 13243
  Description of Artificial Sequence: Synthetic probe

SEQ ID NO: 23058 - DNA, 60 bp, Artificial Sequence; identical to SEQ ID NO: 13258
  Description of Artificial Sequence: Synthetic probe

SEQ ID NO: 23059 - DNA, 60 bp, Artificial Sequence; identical to SEQ ID NO: 13259
  Description of Artificial Sequence: Synthetic probe

SEQ ID NO: 23060 - DNA, 60 bp, Artificial Sequence; identical to SEQ ID NO: 13276
  Description of Artificial Sequence: Synthetic probe

SEQ ID NO: 23061 - DNA, 60 bp, Artificial Sequence; identical to SEQ ID NO: 13282
  Description of Artificial Sequence: Synthetic probe

SEQ ID NO: 23062 - DNA, 60 bp, Artificial Sequence; identical to SEQ ID NO: 13301
  Description of Artificial Sequence: Synthetic probe

SEQ ID NO: 23063 - DNA, 60 bp, Artificial Sequence; identical to SEQ ID NO: 13302
  Description of Artificial Sequence: Synthetic probe

SEQ ID NO: 23064 - DNA, 60 bp, Artificial Sequence; identical to SEQ ID NO: 13303
  Description of Artificial Sequence: Synthetic probe

SEQ ID NO: 23065 - DNA, 60 bp, Artificial Sequence; identical to SEQ ID NO: 13304
  Description of Artificial Sequence: Synthetic probe

SEQ ID NO: 23066 - DNA, 60 bp, Artificial Sequence; identical to SEQ ID NO: 13305
  Description of Artificial Sequence: Synthetic probe

SEQ ID NO: 23067 - DNA, 60 bp, Artificial Sequence; identical to SEQ ID NO: 13306
  Description of Artificial Sequence: Synthetic probe

SEQ ID NO: 23068 - DNA, 60 bp, Artificial Sequence; identical to SEQ ID NO: 13307
  Description of Artificial Sequence: Synthetic probe

SEQ ID NO: 23069 - DNA, 60 bp, Artificial Sequence; identical to SEQ ID NO: 13309
  Description of Artificial Sequence: Synthetic probe

SEQ ID NO: 23070 - DNA, 60 bp, Artificial Sequence; identical to SEQ ID NO: 13310
  Description of Artificial Sequence: Synthetic probe

SEQ ID NO: 23071 - DNA, 60 bp, Artificial Sequence; identical to SEQ ID NO: 13311
  Description of Artificial Sequence: Synthetic probe

SEQ ID NO: 23072 - DNA, 60 bp, Artificial Sequence; identical to SEQ ID NO: 13312
  Description of Artificial Sequence: Synthetic probe

SEQ ID NO: 23073 - DNA, 60 bp, Artificial Sequence; identical to SEQ ID NO: 13327
  Description of Artificial Sequence: Synthetic probe

SEQ ID NO: 23074 - DNA, 58 bp, Artificial Sequence; identical to SEQ ID NO: 13389
  Description of Artificial Sequence: Synthetic probe

SEQ ID NO: 23075 - DNA, 59 bp, Artificial Sequence; identical to SEQ ID NO: 13390
  Description of Artificial Sequence: Synthetic probe

SEQ ID NO: 23076 - DNA, 60 bp, Artificial Sequence; identical to SEQ ID NO: 13391
  Description of Artificial Sequence: Synthetic probe

SEQ ID NO: 23077 - DNA, 60 bp, Artificial Sequence; identical to SEQ ID NO: 13392
  Description of Artificial Sequence: Synthetic probe

SEQ ID NO: 23078 - DNA, 60 bp, Artificial Sequence; identical to SEQ ID NO: 13393
  Description of Artificial Sequence: Synthetic probe

SEQ ID NO: 23079 - DNA, 60 bp, Artificial Sequence; identical to SEQ ID NO: 13394
  Description of Artificial Sequence: Synthetic probe

SEQ ID NO: 23080 - DNA, 60 bp, Artificial Sequence; identical to SEQ ID NO: 13395
  Description of Artificial Sequence: Synthetic probe

SEQ ID NO: 23081 - DNA, 60 bp, Artificial Sequence; identical to SEQ ID NO: 13446
  Description of Artificial Sequence: Synthetic probe

SEQ ID NO: 23082 - DNA, 60 bp, Artificial Sequence; identical to SEQ ID NO: 13447
  Description of Artificial Sequence: Synthetic probe

SEQ ID NO: 23083 - DNA, 60 bp, Artificial Sequence; identical to SEQ ID NO: 13448
  Description of Artificial Sequence: Synthetic probe

SEQ ID NO: 23084 - DNA, 60 bp, Artificial Sequence; identical to SEQ ID NO: 13449
  Description of Artificial Sequence: Synthetic probe

SEQ ID NO: 23085 - DNA, 60 bp, Artificial Sequence; identical to SEQ ID NO: 13459
  Description of Artificial Sequence: Synthetic probe

SEQ ID NO: 23086 - DNA, 55 bp, Artificial Sequence; identical to SEQ ID NO: 13470
  Description of Artificial Sequence: Synthetic probe

SEQ ID NO: 23087 - DNA, 60 bp, Artificial Sequence; identical to SEQ ID NO: 13514
  Description of Artificial Sequence: Synthetic probe

SEQ ID NO: 23088 - DNA, 55 bp, Artificial Sequence; identical to SEQ ID NO: 13522
  Description of Artificial Sequence: Synthetic probe

SEQ ID NO: 23089 - DNA, 60 bp, Artificial Sequence; identical to SEQ ID NO: 13523
  Description of Artificial Sequence: Synthetic probe

SEQ ID NO: 23090 - DNA, 60 bp, Artificial Sequence; identical to SEQ ID NO: 13536
  Description of Artificial Sequence: Synthetic probe

SEQ ID NO: 23091 - DNA, 60 bp, Artificial Sequence; identical to SEQ ID NO: 13537
  Description of Artificial Sequence: Synthetic probe

SEQ ID NO: 23092 - DNA, 60 bp, Artificial Sequence; identical to SEQ ID NO: 13538
  Description of Artificial Sequence: Synthetic probe

SEQ ID NO: 23093 - DNA, 60 bp, Artificial Sequence; identical to SEQ ID NO: 13539
  Description of Artificial Sequence: Synthetic probe

SEQ ID NO: 23094 - DNA, 60 bp, Artificial Sequence; identical to SEQ ID NO: 13540
  Description of Artificial Sequence: Synthetic probe

SEQ ID NO: 23095 - DNA, 60 bp, Artificial Sequence; identical to SEQ ID NO: 13541
  Description of Artificial Sequence: Synthetic probe

SEQ ID NO: 23096 - DNA, 60 bp, Artificial Sequence; identical to SEQ ID NO: 13542
  Description of Artificial Sequence: Synthetic probe

SEQ ID NO: 23097 - DNA, 60 bp, Artificial Sequence; identical to SEQ ID NO: 13552
  Description of Artificial Sequence: Synthetic probe

SEQ ID NO: 23098 - DNA, 60 bp, Artificial Sequence; identical to SEQ ID NO: 13553
  Description of Artificial Sequence: Synthetic probe

SEQ ID NO: 23099 - DNA, 60 bp, Artificial Sequence; identical to SEQ ID NO: 13554
  Description of Artificial Sequence: Synthetic probe

SEQ ID NO: 23100 - DNA, 60 bp, Artificial Sequence; identical to SEQ ID NO: 13555
  Description of Artificial Sequence: Synthetic probe

SEQ ID NO: 23101 - DNA, 52 bp, Artificial Sequence; identical to SEQ ID NO: 13564
  Description of Artificial Sequence: Synthetic probe

SEQ ID NO: 23102 - DNA, 60 bp, Artificial Sequence; identical to SEQ ID NO: 13565
  Description of Artificial Sequence: Synthetic probe

SEQ ID NO: 23103 - DNA, 60 bp, Artificial Sequence; identical to SEQ ID NO: 13566
  Description of Artificial Sequence: Synthetic probe

SEQ ID NO: 23104 - DNA, 60 bp, Artificial Sequence; identical to SEQ ID NO: 13567
  Description of Artificial Sequence: Synthetic probe

SEQ ID NO: 23105 - DNA, 60 bp, Artificial Sequence; identical to SEQ ID NO: 13568
  Description of Artificial Sequence: Synthetic probe

SEQ ID NO: 23106 - DNA, 60 bp, Artificial Sequence; identical to SEQ ID NO: 13569
  Description of Artificial Sequence: Synthetic probe

SEQ ID NO: 23107 - DNA, 60 bp, Artificial Sequence; identical to SEQ ID NO: 13570
  Description of Artificial Sequence: Synthetic probe

SEQ ID NO: 23108 - DNA, 60 bp, Artificial Sequence; identical to SEQ ID NO: 13571
  Description of Artificial Sequence: Synthetic probe

SEQ ID NO: 23109 - DNA, 60 bp, Artificial Sequence; identical to SEQ ID NO: 13572
  Description of Artificial Sequence: Synthetic probe

SEQ ID NO: 23110 - DNA, 60 bp, Artificial Sequence; identical to SEQ ID NO: 13573
  Description of Artificial Sequence: Synthetic probe

SEQ ID NO: 23111 - DNA, 60 bp, Artificial Sequence; identical to SEQ ID NO: 13574
  Description of Artificial Sequence: Synthetic probe

SEQ ID NO: 23112 - DNA, 60 bp, Artificial Sequence; identical to SEQ ID NO: 13575
  Description of Artificial Sequence: Synthetic probe

SEQ ID NO: 23113 - DNA, 60 bp, Artificial Sequence; identical to SEQ ID NO: 13576
  Description of Artificial Sequence: Synthetic probe

SEQ ID NO: 23114 - DNA, 60 bp, Artificial Sequence; identical to SEQ ID NO: 13577
  Description of Artificial Sequence: Synthetic probe

SEQ ID NO: 23115 - DNA, 60 bp, Artificial Sequence; identical to SEQ ID NO: 13578
  Description of Artificial Sequence: Synthetic probe

SEQ ID NO: 23116 - DNA, 60 bp, Artificial Sequence; identical to SEQ ID NO: 13579
  Description of Artificial Sequence: Synthetic probe

SEQ ID NO: 23117 - DNA, 60 bp, Artificial Sequence; identical to SEQ ID NO: 13580
  Description of Artificial Sequence: Synthetic probe

SEQ ID NO: 23118 - DNA, 56 bp, Artificial Sequence; identical to SEQ ID NO: 13581
  Description of Artificial Sequence: Synthetic probe

SEQ ID NO: 23119 - DNA, 57 bp, Artificial Sequence; identical to SEQ ID NO: 13582
  Description of Artificial Sequence: Synthetic probe

SEQ ID NO: 23120 - DNA, 60 bp, Artificial Sequence; identical to SEQ ID NO: 13583
  Description of Artificial Sequence: Synthetic probe

SEQ ID NO: 23121 - DNA, 60 bp, Artificial Sequence; identical to SEQ ID NO: 13584
  Description of Artificial Sequence: Synthetic probe

SEQ ID NO: 23122 - DNA, 60 bp, Artificial Sequence; identical to SEQ ID NO: 13585
  Description of Artificial Sequence: Synthetic probe

SEQ ID NO: 23123 - DNA, 60 bp, Artificial Sequence; identical to SEQ ID NO: 13586
  Description of Artificial Sequence: Synthetic probe

SEQ ID NO: 23124 - DNA, 60 bp, Artificial Sequence; identical to SEQ ID NO: 13587
  Description of Artificial Sequence: Synthetic probe

SEQ ID NO: 23125 - DNA, 60 bp, Artificial Sequence; identical to SEQ ID NO: 13588
  Description of Artificial Sequence: Synthetic probe

SEQ ID NO: 23126 - DNA, 60 bp, Artificial Sequence; identical to SEQ ID NO: 13589
  Description of Artificial Sequence: Synthetic probe

SEQ ID NO: 23127 - DNA, 60 bp, Artificial Sequence; identical to SEQ ID NO: 13613
  Description of Artificial Sequence: Synthetic probe

SEQ ID NO: 23128 - DNA, 55 bp, Artificial Sequence; identical to SEQ ID NO: 13614
  Description of Artificial Sequence: Synthetic probe

SEQ ID NO: 23129 - DNA, 60 bp, Artificial Sequence; identical to SEQ ID NO: 13615
  Description of Artificial Sequence: Synthetic probe

SEQ ID NO: 23130 - DNA, 60 bp, Artificial Sequence; identical to SEQ ID NO: 13616
  Description of Artificial Sequence: Synthetic probe

SEQ ID NO: 23131 - DNA, 60 bp, Artificial Sequence; identical to SEQ ID NO: 13617
  Description of Artificial Sequence: Synthetic probe

SEQ ID NO: 23132 - DNA, 60 bp, Artificial Sequence; identical to SEQ ID NO: 13618
  Description of Artificial Sequence: Synthetic probe

SEQ ID NO: 23133 - DNA, 60 bp, Artificial Sequence; identical to SEQ ID NO: 13619
  Description of Artificial Sequence: Synthetic probe

SEQ ID NO: 23134 - DNA, 60 bp, Artificial Sequence; identical to SEQ ID NO: 13620
  Description of Artificial Sequence: Synthetic probe

SEQ ID NO: 23135 - DNA, 60 bp, Artificial Sequence; identical to SEQ ID NO: 13621
  Description of Artificial Sequence: Synthetic probe

SEQ ID NO: 23136 - DNA, 60 bp, Artificial Sequence; identical to SEQ ID NO: 13622
  Description of Artificial Sequence: Synthetic probe

SEQ ID NO: 23137 - DNA, 60 bp, Artificial Sequence; identical to SEQ ID NO: 13666
  Description of Artificial Sequence: Synthetic probe

SEQ ID NO: 23138 - DNA, 60 bp, Artificial Sequence; identical to SEQ ID NO: 13667
  Description of Artificial Sequence: Synthetic probe

SEQ ID NO: 23139 - DNA, 60 bp, Artificial Sequence; identical to SEQ ID NO: 13677
  Description of Artificial Sequence: Synthetic probe

SEQ ID NO: 23140 - DNA, 60 bp, Artificial Sequence; identical to SEQ ID NO: 13711
  Description of Artificial Sequence: Synthetic probe

SEQ ID NO: 23141 - DNA, 60 bp, Artificial Sequence; identical to SEQ ID NO: 13719
  Description of Artificial Sequence: Synthetic probe

SEQ ID NO: 23142 - DNA, 60 bp, Artificial Sequence; identical to SEQ ID NO: 13805
  Description of Artificial Sequence: Synthetic probe

SEQ ID NO: 23143 - DNA, 60 bp, Artificial Sequence; identical to SEQ ID NO: 13883
  Description of Artificial Sequence: Synthetic probe

SEQ ID NO: 23144 - DNA, 60 bp, Artificial Sequence; identical to SEQ ID NO: 13884
  Description of Artificial Sequence: Synthetic probe

SEQ ID NO: 23145 - DNA, 60 bp, Artificial Sequence; identical to SEQ ID NO: 13885
  Description of Artificial Sequence: Synthetic probe

SEQ ID NO: 23146 - DNA, 60 bp, Artificial Sequence; identical to SEQ ID NO: 13886
  Description of Artificial Sequence: Synthetic probe

SEQ ID NO: 23147 - DNA, 60 bp, Artificial Sequence; identical to SEQ ID NO: 13887
  Description of Artificial Sequence: Synthetic probe

SEQ ID NO: 23148 - DNA, 60 bp, Artificial Sequence; identical to SEQ ID NO: 13888
  Description of Artificial Sequence: Synthetic probe

SEQ ID NO: 23149 - DNA, 60 bp, Artificial Sequence; identical to SEQ ID NO: 13889
  Description of Artificial Sequence: Synthetic probe

SEQ ID NO: 23150 - DNA, 60 bp, Artificial Sequence; identical to SEQ ID NO: 13890
  Description of Artificial Sequence: Synthetic probe

SEQ ID NO: 23151 - DNA, 60 bp, Artificial Sequence; identical to SEQ ID NO: 13891
  Description of Artificial Sequence: Synthetic probe

SEQ ID NO: 23152 - DNA, 60 bp, Artificial Sequence; identical to SEQ ID NO: 13892
  Description of Artificial Sequence: Synthetic probe

SEQ ID NO: 23153 - DNA, 60 bp, Artificial Sequence; identical to SEQ ID NO: 13893
  Description of Artificial Sequence: Synthetic probe

SEQ ID NO: 23154 - DNA, 60 bp, Artificial Sequence; identical to SEQ ID NO: 13894
  Description of Artificial Sequence: Synthetic probe

SEQ ID NO: 23155 - DNA, 60 bp, Artificial Sequence; identical to SEQ ID NO: 13895
  Description of Artificial Sequence: Synthetic probe

SEQ ID NO: 23156 - DNA, 60 bp, Artificial Sequence; identical to SEQ ID NO: 13928
  Description of Artificial Sequence: Synthetic probe

SEQ ID NO: 23157 - DNA, 60 bp, Artificial Sequence; identical to SEQ ID NO: 13980
  Description of Artificial Sequence: Synthetic probe

SEQ ID NO: 23158 - DNA, 60 bp, Artificial Sequence; identical to SEQ ID NO: 14000
  Description of Artificial Sequence: Synthetic probe

SEQ ID NO: 23159 - DNA, 60 bp, Artificial Sequence; identical to SEQ ID NO: 14001
  Description of Artificial Sequence: Synthetic probe

SEQ ID NO: 23160 - DNA, 60 bp, Artificial Sequence; identical to SEQ ID NO: 14002
  Description of Artificial Sequence: Synthetic probe

SEQ ID NO: 23161 - DNA, 60 bp, Artificial Sequence; identical to SEQ ID NO: 14003
  Description of Artificial Sequence: Synthetic probe

SEQ ID NO: 23162 - DNA, 60 bp, Artificial Sequence; identical to SEQ ID NO: 14004
  Description of Artificial Sequence: Synthetic probe

SEQ ID NO: 23163 - DNA, 54 bp, Artificial Sequence; identical to SEQ ID NO: 14005
  Description of Artificial Sequence: Synthetic probe

SEQ ID NO: 23164 - DNA, 60 bp, Artificial Sequence; identical to SEQ ID NO: 14006
  Description of Artificial Sequence: Synthetic probe

SEQ ID NO: 23165 - DNA, 50 bp, Artificial Sequence; identical to SEQ ID NO: 14007
  Description of Artificial Sequence: Synthetic probe

SEQ ID NO: 23166 - DNA, 50 bp, Artificial Sequence; identical to SEQ ID NO: 14052
  Description of Artificial Sequence: Synthetic probe

SEQ ID NO: 23167 - DNA, 54 bp, Artificial Sequence; identical to SEQ ID NO: 14064
  Description of Artificial Sequence: Synthetic probe

SEQ ID NO: 23168 - DNA, 54 bp, Artificial Sequence; identical to SEQ ID NO: 14066
  Description of Artificial Sequence: Synthetic probe

SEQ ID NO: 23169 - DNA, 60 bp, Artificial Sequence; identical to SEQ ID NO: 14067
  Description of Artificial Sequence: Synthetic probe

SEQ ID NO: 23170 - DNA, 60 bp, Artificial Sequence; identical to SEQ ID NO: 14071
  Description of Artificial Sequence: Synthetic probe

SEQ ID NO: 23171 - DNA, 60 bp, Artificial Sequence; identical to SEQ ID NO: 14101
  Description of Artificial Sequence: Synthetic probe

SEQ ID NO: 23172 - DNA, 60 bp, Artificial Sequence; identical to SEQ ID NO: 14108
  Description of Artificial Sequence: Synthetic probe

SEQ ID NO: 23173 - DNA, 60 bp, Artificial Sequence; identical to SEQ ID NO: 14117
  Description of Artificial Sequence: Synthetic probe

SEQ ID NO: 23174 - DNA, 59 bp, Artificial Sequence; identical to SEQ ID NO: 14167
  Description of Artificial Sequence: Synthetic probe

SEQ ID NO: 23175 - DNA, 60 bp, Artificial Sequence; identical to SEQ ID NO: 14170
  Description of Artificial Sequence: Synthetic probe

SEQ ID NO: 23176 - DNA, 60 bp, Artificial Sequence; identical to SEQ ID NO: 14172
  Description of Artificial Sequence: Synthetic probe

SEQ ID NO: 23177 - DNA, 60 bp, Artificial Sequence; identical to SEQ ID NO: 14173
  Description of Artificial Sequence: Synthetic probe

SEQ ID NO: 23178 - DNA, 60 bp, Artificial Sequence; identical to SEQ ID NO: 14194
  Description of Artificial Sequence: Synthetic probe

SEQ ID NO: 23179 - DNA, 60 bp, Artificial Sequence; identical to SEQ ID NO: 14203
  Description of Artificial Sequence: Synthetic probe

SEQ ID NO: 23180 - DNA, 60 bp, Artificial Sequence; identical to SEQ ID NO: 14204
  Description of Artificial Sequence: Synthetic probe

SEQ ID NO: 23181 - DNA, 60 bp, Artificial Sequence; identical to SEQ ID NO: 14205
  Description of Artificial Sequence: Synthetic probe

SEQ ID NO: 23182 - DNA, 60 bp, Artificial Sequence; identical to SEQ ID NO: 14206
  Description of Artificial Sequence: Synthetic probe

SEQ ID NO: 23183 - DNA, 60 bp, Artificial Sequence; identical to SEQ ID NO: 14207
  Description of Artificial Sequence: Synthetic probe

SEQ ID NO: 23184 - DNA, 60 bp, Artificial Sequence; identical to SEQ ID NO: 14209
  Description of Artificial Sequence: Synthetic probe

SEQ ID NO: 23185 - DNA, 60 bp, Artificial Sequence; identical to SEQ ID NO: 14210
  Description of Artificial Sequence: Synthetic probe

SEQ ID NO: 23186 - DNA, 60 bp, Artificial Sequence; identical to SEQ ID NO: 14211
  Description of Artificial Sequence: Synthetic probe

SEQ ID NO: 23187 - DNA, 60 bp, Artificial Sequence; identical to SEQ ID NO: 14212
  Description of Artificial Sequence: Synthetic probe

SEQ ID NO: 23188 - DNA, 60 bp, Artificial Sequence; identical to SEQ ID NO: 14213
  Description of Artificial Sequence: Synthetic probe

SEQ ID NO: 23189 - DNA, 12 bp, Artificial Sequence
  Description of Artificial Sequence: Synthetic probe
atccgcgcatag

SEQ ID NO: 23190 - DNA, 18 bp, Artificial Sequence
  Description of Artificial Sequence: Synthetic primer
  modified_base (2)..(2): iBiodT
  modified_base (13)..(13): iBiodT
gtgccagccgcgtaaaag
